(12) United States Patent
Baum et al.

(10) Patent No.: US 12,496,470 B2
(45) Date of Patent: Dec. 16, 2025

(54) ANTI-SARS-CoV-2-SPIKE GLYCOPROTEIN ANTIBODIES AND ANTIGEN-BINDING FRAGMENTS

(71) Applicant: Regeneron Pharmaceuticals, Inc., Tarrytown, NY (US)

(72) Inventors: Alina Baum, Pleasantville, NY (US); Christos Kyratsous, Irvington, NY (US); George D. Yancopoulos, Yorktown Heights, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 381 days.

(21) Appl. No.: 17/863,864

(22) Filed: Jul. 13, 2022

(65) Prior Publication Data

US 2023/0125469 A1    Apr. 27, 2023

Related U.S. Application Data

(60) Provisional application No. 63/354,632, filed on Jun. 22, 2022, provisional application No. 63/306,909, (Continued)

(51) Int. Cl.
*A61P 31/14* (2006.01)
*A61K 39/00* (2006.01)
(Continued)

(52) U.S. Cl.
CPC ............. *A61K 39/42* (2013.01); *A61P 31/14* (2018.01); *C07K 14/005* (2013.01); *C07K 16/1003* (2023.08); *C12N 15/85* (2013.01); *A61K 2039/505* (2013.01); *C07K 2317/21* (2013.01); *C07K 2317/31* (2013.01); (Continued)

(58) Field of Classification Search
None
See application file for complete search history.

(56) References Cited

U.S. PATENT DOCUMENTS 5,908,635 A    6/1999  Thierry
10,787,501 B1  9/2020  Babb et al.
(Continued)

FOREIGN PATENT DOCUMENTS

CN    111088283 A    5/2020
CN    111285933 A    6/2020
(Continued)

OTHER PUBLICATIONS

Chen et al., Enhancement and destruction of antibody function by somatic mutation: unequal occurrence is controlled by V gene combinatorial associations. EMBO J. Jun. 15, 1995;14(12):2784-94. (Year: 1995).*

(Continued)

*Primary Examiner* — Aurora M Fontainhas
*Assistant Examiner* — Selam Berhane
(74) *Attorney, Agent, or Firm* — Schwabe, Williamson & Wyatt PC; Gabe Amodeo

(57) ABSTRACT

The present disclosure provides antibodies and antigen-binding fragments thereof that bind specifically to a coronavirus spike protein and methods of using such antibodies and fragments for treating or preventing viral infections (e.g., coronavirus infections).

20 Claims, 22 Drawing Sheets

Specification includes a Sequence Listing.

Related U.S. Application Data filed on Feb. 4, 2022, provisional application No. 63/301,002, filed on Jan. 19, 2022, provisional application No. 63/291,328, filed on Dec. 17, 2021, provisional application No. 63/289,419, filed on Dec. 14, 2021, provisional application No. 63/289,126, filed on Dec. 13, 2021, provisional application No. 63/286,514, filed on Dec. 6, 2021, provisional application No. 63/245,020, filed on Sep. 16, 2021, provisional application No. 63/221,846, filed on Jul. 14, 2021.

(51) Int. Cl.
*A61K 39/42* (2006.01)
*C07K 14/005* (2006.01)
*C07K 16/10* (2006.01)
*C12N 15/85* (2006.01)

(52) U.S. Cl.
CPC .... *C07K 2317/33* (2013.01); *C07K 2317/565* (2013.01); *C07K 2317/732* (2013.01); *C07K 2317/76* (2013.01); *C07K 2317/92* (2013.01)

(56) References Cited

U.S. PATENT DOCUMENTS

| | | |
|---|---|---|
| 10,822,379 B1 | 11/2020 | Dimitrov et al. |
| 10,954,289 B1 | 3/2021 | Babb et al. |
| 10,975,139 B1 | 4/2021 | Babb et al. |
| 11,020,474 B1 | 6/2021 | Xiang et al. |
| 11,021,531 B1 | 6/2021 | Glanville et al. |
| 11,021,532 B1 | 6/2021 | Glanville et al. |
| 11,028,150 B1 | 6/2021 | Glanville et al. |
| 11,028,167 B1 | 6/2021 | Glanville et al. |
| 11,732,030 B2 | 8/2023 | Babb et al. |
| 11,999,777 B2 | 6/2024 | Ganguly et al. |
| 2006/0240551 A1 | 10/2006 | Jiang et al. |
| 2011/0159001 A1 | 6/2011 | Lanzavecchia |
| 2017/0096455 A1 | 4/2017 | Baric et al. |
| 2017/0355756 A1* | 12/2017 | Julien .................. C07K 16/18 |
| 2021/0031123 A1 | 2/2021 | Liu et al. |
| 2021/0093709 A1 | 4/2021 | Wu et al. |
| 2021/0260201 A1 | 8/2021 | Chukly et al. |
| 2021/0275665 A1 | 9/2021 | Cho |
| 2021/0277093 A1 | 9/2021 | Mond et al. |
| 2021/0388065 A1 | 12/2021 | Lu et al. |

FOREIGN PATENT DOCUMENTS

| | | |
|---|---|---|
| CN | 111303254 A | 6/2020 |
| CN | 111303279 A | 6/2020 |
| CN | 111303280 A | 6/2020 |
| CN | 111333704 B | 6/2020 |
| CN | 111333722 A | 6/2020 |
| CN | 111420048 A | 7/2020 |
| CN | 111423508 A | 7/2020 |
| CN | 111440229 A | 7/2020 |
| CN | 111471105 A | 7/2020 |
| CN | 111499692 A | 8/2020 |
| CN | 111499765 A | 8/2020 |
| CN | 111518773 A | 8/2020 |
| CN | 111560399 A | 8/2020 |
| CN | 111574614 A | 8/2020 |
| CN | 111592594 A | 8/2020 |
| CN | 111592595 A | 8/2020 |
| CN | 111607003 A | 9/2020 |
| CN | 111620945 B | 9/2020 |
| CN | 111620946 B | 9/2020 |
| CN | 111647053 A | 9/2020 |
| CN | 111647076 B | 9/2020 |
| CN | 111647077 B | 9/2020 |
| CN | 111662379 B | 9/2020 |
| CN | 111690058 B | 9/2020 |
| CN | 111690059 A | 9/2020 |
| CN | 111690060 A | 9/2020 |
| CN | 111714621 B | 9/2020 |
| CN | 111718411 A | 9/2020 |
| CN | 111732654 B | 10/2020 |
| CN | 111732655 A | 10/2020 |
| CN | 111732664 B | 10/2020 |
| CN | 111748032 B | 10/2020 |
| CN | 111778218 A | 10/2020 |
| CN | 111793129 A | 10/2020 |
| CN | 111825762 A | 10/2020 |
| CN | 111825771 A | 10/2020 |
| CN | 111848750 A | 10/2020 |
| CN | 111848751 A | 10/2020 |
| CN | 111848789 A | 10/2020 |
| CN | 111875701 A | 11/2020 |
| CN | 111909260 A | 11/2020 |
| CN | 111909261 A | 11/2020 |
| CN | 111909262 A | 11/2020 |
| CN | 111909263 A | 11/2020 |
| CN | 111925439 A | 11/2020 |
| CN | 111925440 A | 11/2020 |
| CN | 111925441 A | 11/2020 |
| CN | 111925442 A | 11/2020 |
| CN | 111925443 A | 11/2020 |
| CN | 111925444 A | 11/2020 |
| CN | 111944026 A | 11/2020 |
| CN | 111978377 A | 11/2020 |
| CN | 111978395 A | 11/2020 |
| CN | 111978396 A | 11/2020 |
| CN | 111978397 A | 11/2020 |
| CN | 111978398 A | 11/2020 |
| CN | 111978399 A | 11/2020 |
| CN | 111995672 A | 11/2020 |
| CN | 111995674 A | 11/2020 |
| CN | 111995678 B | 11/2020 |
| CN | 112010962 A | 12/2020 |
| CN | 112010963 A | 12/2020 |
| CN | 112010964 A | 12/2020 |
| CN | 112010967 B | 12/2020 |
| CN | 112062838 B | 12/2020 |
| CN | 112062839 A | 12/2020 |
| CN | 112062840 A | 12/2020 |
| CN | 112062859 A | 12/2020 |
| CN | 112076316 A | 12/2020 |
| CN | 112094326 A | 12/2020 |
| CN | 112094327 A | 12/2020 |
| CN | 112094340 A | 12/2020 |
| CN | 112094342 A | 12/2020 |
| CN | 112094343 A | 12/2020 |
| CN | 112125973 A | 12/2020 |
| CN | 112159469 A | 1/2021 |
| CN | 112175071 A | 1/2021 |
| CN | 112175073 A | 1/2021 |
| CN | 112194711 A | 1/2021 |
| CN | 112210004 A | 1/2021 |
| CN | 112250763 A | 1/2021 |
| CN | 112251414 A | 1/2021 |
| CN | 112300274 A | 2/2021 |
| CN | 112341541 A | 2/2021 |
| CN | 112341542 B | 2/2021 |
| CN | 112390879 B | 2/2021 |
| CN | 112409479 A | 2/2021 |
| CN | 112409488 A | 2/2021 |
| CN | 112430265 A | 3/2021 |
| CN | 112442120 A | 3/2021 |
| CN | 112485455 A | 3/2021 |
| CN | 112500480 A | 3/2021 |
| CN | 112500481 A | 3/2021 |
| CN | 112513076 A | 3/2021 |
| CN | 112521494 A | 3/2021 |
| CN | 112521496 A | 3/2021 |
| CN | 112522203 A | 3/2021 |
| CN | 112538111 A | 3/2021 |
| CN | 112552399 A | 3/2021 |
| CN | 112574299 A | 3/2021 |
| CN | 112574300 A | 3/2021 |
| CN | 112625125 A | 4/2021 |
| CN | 112625136 A | 4/2021 |
| CN | 112626030 A | 4/2021 |
| CN | 112626089 A | 4/2021 |

(56) References Cited

FOREIGN PATENT DOCUMENTS

| | | | |
|---|---|---|---|
| CN | 112646005 A | 4/2021 | |
| CN | 112661841 A | 4/2021 | |
| CN | 112724247 A | 4/2021 | |
| CN | 112724248 A | 4/2021 | |
| CN | 112794898 A | 5/2021 | |
| CN | 112794899 A | 5/2021 | |
| CN | 112851804 A | 5/2021 | |
| CN | 112980885 A | 6/2021 | |
| CN | 113045647 A | 6/2021 | |
| CN | 113072640 A | 7/2021 | |
| CN | 113150129 A | 7/2021 | |
| CN | 113150130 A | 7/2021 | |
| CN | 113150132 A | 7/2021 | |
| CN | 113150135 A | 7/2021 | |
| CN | 113151184 A | 7/2021 | |
| CN | 113173995 A | 7/2021 | |
| CN | 113185609 A | 7/2021 | |
| CN | 113214389 A | 8/2021 | |
| CN | 113215106 A | 8/2021 | |
| CN | 113234148 A | 8/2021 | |
| CN | 113234149 A | 8/2021 | |
| CN | 113234150 A | 8/2021 | |
| CN | 113234151 A | 8/2021 | |
| CN | 113248579 A | 8/2021 | |
| CN | 113248581 A | 8/2021 | |
| CN | 113264998 A | 8/2021 | |
| CN | 113292649 A | 8/2021 | |
| CN | 113292650 A | 8/2021 | |
| CN | 113307865 A | 8/2021 | |
| CN | 113336846 A | 9/2021 | |
| CN | 113354731 A | 9/2021 | |
| CN | 113354733 A | 9/2021 | |
| DE | 202020105116 | 11/2020 | |
| EP | 3872091 A1 | 9/2021 | |
| EP | 3885361 A1 | 9/2021 | |
| KR | 102205028 B1 | 1/2021 | |
| KR | 102229225 B1 | 3/2021 | |
| KR | 102233689 B1 | 3/2021 | |
| RU | 2744274 C1 | 3/2021 | |
| WO | 2005/018535 A2 | 3/2005 | |
| WO | 2005/060520 A2 | 7/2005 | |
| WO | WO-2008068048 A2 * | 6/2008 | ............. A61P 31/10 |
| WO | 2015/179535 A1 | 11/2015 | |
| WO | 2019/147831 A1 | 8/2019 | |
| WO | 2021/001388 A1 | 1/2021 | |
| WO | 2021/026074 A1 | 2/2021 | |
| WO | 2021/035177 A2 | 2/2021 | |
| WO | 2021/045836 A1 | 3/2021 | |
| WO | 2021/058521 A1 | 4/2021 | |
| WO | 2021/072399 A1 | 4/2021 | |
| WO | 2021/096980 A1 | 5/2021 | |
| WO | 2021/148884 A1 | 7/2021 | |
| WO | 2021/151100 A1 | 7/2021 | |
| WO | 2021/155639 A1 | 8/2021 | |
| WO | 2021/163265 A1 | 8/2021 | |
| WO | 2021/168483 A2 | 8/2021 | |
| WO | 2021/173879 A1 | 9/2021 | |
| WO | 2021/180602 A1 | 9/2021 | |
| WO | 2021/183195 A1 | 9/2021 | |
| WO | 2021/183359 A1 | 9/2021 | |
| WO | 2021/183790 A1 | 9/2021 | |
| WO | 2021/190980 A1 | 9/2021 | |
| WO | 2021/203053 A1 | 10/2021 | |
| WO | 2021/222935 A2 | 11/2021 | |
| WO | 2021/226560 A1 | 11/2021 | |
| WO | 2021/233834 A1 | 11/2021 | |
| WO | 2021/239935 A1 | 12/2021 | |
| WO | 2021/242815 A1 | 12/2021 | |
| WO | 2021/245184 A1 | 12/2021 | |
| WO | 2021/249547 A1 | 12/2021 | |
| WO | 2022/090353 A1 | 5/2022 | |
| WO | 2022/162587 A1 | 8/2022 | |

OTHER PUBLICATIONS

Edwards et al., The remarkable flexibility of the human antibody repertoire; isolation of over one thousand different antibodies to a single protein, BLyS. J Mol Biol. Nov. 14, 2003;334(1):103-18. (Year: 2003).*

Koenig et al., Mutational landscape of antibody variable domains reveals a switch modulating the interdomain conformational dynamics and antigen binding. PNAS Jan. 24, 2017 114 (4) E486-E495; first published Jan. 5, 2017; (Year: 2017).*

Kussie, Paul H., "A Single Engineered Amino Acid Substitution Changes Antibody Fine Specificity", 1994, Journal of Immunology 152(1): pp. 146-152. (Year: 1994).*

Andreano et al., "Identification of neutralizing human monoclonal antibodies from Italian Covid-19 convalescent patients," bioRxiv 2020.05.05.078154; (2020) doi: https://doi.org/10.1101/2020.05.05.078154.

Barnes et al., "Structures of human antibodies bound to SARS-CoV-2 spike reveal common epitopes and recurrent features of antibodies," Structures of human antibodies bound to SARS-CoV-2 spike reveal common epitopes and recurrent features of antibodies, Cell (2020), doi: https://doi.org/10.1016/j.cell.2020.06.025.

Barnes et al., "Structures of Human Antibodies Bound to SARS-CoV-2 Spike Reveal Common Epitopes and Recurrent Features of Antibodies," Cell, Volume(182, Issue 4): 828-842, Jun. 23, 2020 (2020).

Baum A, Copin R, Ajithdoss D, et al. REGN-COV2 antibody cocktail prevents and treats SARS-CoV-2 infection in rhesus macaques and hamsters. bioRxiv 2020:2020.08.02.233320.

Baum A, Fulton BO, Wloga E, et al. Antibody cocktail to SARS-CoV-2 spike protein prevents rapid mutational escape seen with individual antibodies. Science 2020.

Baum et al., "Antibody cocktail to SARS-CoV-2 spike protein prevents rapid mutational escape seen with individual antibodies," Science, vol. (1):1-17, (2020). [Retrieved from the Internet Jun. 30, 2020: <URL: http://science.sciencemag.org].

Baum et al., "Antibody cocktail to SARS-CoV-2 spike protein prevens rapid mutational escape seen with individual antibodies," Science, pp. 1-8, (Jun. 15, 2020). [Retrieved from the Internet Jun. 23, 2020 from http://science.sciencemag.org/].

Bertoglio et al., "SARS-CoV-2 neutralizing human recombinant antibodies selected from pre-pandemic healthy donors binding at RBD-ACE2 interface," bioRxiv 2020.06.05.135921; (2020) doi: https://doi.org/10.1101/2020.06.05.135921.

Blanco-Melo D, Nilsson-Payant BE, Liu WC, et al. Imbalanced Host Response to SARS-CoV-2 Drives Development of COVID-19. Cell 2020;181:1036-45 e9.

Brouwer et al., "Potent neutralizing antibodies from COVID-19 patients define multiple targets of vulnerability" Science 10.1126/Science.abc5902 (2020).

Brouwer et al., "Potent neutralizing antibodies from COVID-19 patients define multiple targets of vulnerability" bioRxiv 2020.05.12.088716; doi: https://doi.org/10.1101/2020.05.12.088716.

Brouwer et al., "Potent neutralizing antibodies from COVID-19 patients define multiple targets of vulnerability," bioRxiv 2020.05.12.088716; (2020) doi: https://doi.org/10.1101/2020.05.12.088716.

Cao et al., "Potent Neurtalizing Antibodies against SARS-CoV-2 Identified by High-Throughput Single-Cell Sequencing of Convalescent Pateitns'B Cells," Cell, vol. (182): 73-84, (2020). [https://doi.org/10.1016/j.cell.2020.05.025].

Cao et al., "Potent Neutralizing Antibodies against SARS-CoV-2 identified by high-throughput single-cell sequencing of convalescent patients' B cells," Cell (2020), doi: https://doi.org/10.1016/j.cell.2020.05.025.

Case et al., "Neutralizing antibody and soluble ACE2 inhibition of a replication-competent VSV-SARS-CoV-2 and a clinical isolate of SARS-CoV-2," bioRxiv 2020.05.18.102038; (2020) doi: https://doi.org/10.1101/2020.05.18.102038.

Chen et al., "Human monoclonal antibodies block the binding of SARS-CoV-2 spike protein to angiotensin converting enzyme 2 receptor," Cellular & Molecular Immunology (2020) https://doi.org/10.1038/s41423-020-0426-7.

(56) References Cited

OTHER PUBLICATIONS

Chen et al., "Resistance of SARS-CoV-2 variants to neutralization by monoclonal and serum-derived polyclonal antibodies," Nature Medicine, vol. (27): 717-726, (2021). [https://doi.org/10.1038/s41591-021-01294-w].

Cheng et al., "An insertion unique to SARS-CoV-2 exhibits superantigenic character strengthened by recent mutations," bioRxiv 2020.05.21.109272; (2020) doi: https://doi.org/10.1101/2020.05.21.109272.

Cheng et al., "Impact of South African 501.V2 Variant on SARS-CoV-2 Spike Infectivity and Neutrlization: A Structure-based Computational Assessment," Bioinformatics, pp. 1-7, (2021). [https://doi.org/10.1101/2021.01.10.426143].

Chi et al., "A neutralizing human antibody binds to the N-terminal domain of the Spike protein of SARS-CoV-2," Science 11.1126/science.abc6952 (2020).

Chi et al., "A potent neutralizing human antibody reveals the N-terminal domain in the Spike protein of SARS-CoV-2 as a site of vulnerability," bioRxiv 2020.05.08.083964; (2020) doi: https://doi.org/10.1101/2020.05.08.083964.

Chi et al., "Humanized Single Domain Antibodies Neutralize SARS-CoV-2 by Targeting Spike Receptor Binding Domain," bioRxiv 2020.04.14.042010; (2020) doi: https://doi.org/10.1101/2020.04.14.042010.

Choi et al., "Characterization of a human monoclonal antibody generated from a B-cell specific for a prefusion-stabilized spike protein of Middle East respiratory syndrome coronavirus," PLoS ONE 15(5): e0232757. https://doi.org/10.1371/journal.pone.0232757.

Choudhury et al., "In silico studies on the comparative characterization of the interactions of SARS-CoV-2 spike glycoprotein with ACE-2 receptor homologs and humans TLRs," (2020) doi: 10.1002/jmv.25987.

Copin et al., "The monoclonal antibody combination REGEN-COV protects against SARS-CoV-2 mutational escape in preclinical and human studies" Cell, vol. (184): 3949-3961, (Jul. 22, 2021). [https://doi.org/10.1016/j.cell.2021.06.002].

Coronavirus Disease 2019 (COVID-19) Situation Report—101. 2020. (Accessed Oct. 6, 2020, at https://www.who.int/docs/default-source/coronaviruse/situation-reports/20200430-sitrep-101-covid-19.pdf?sfvrsn=2ba4e093_2.).

Crooke et al., "Immunoinformatic identification of B cell and T cell epitopes in the SARS-CoV-2 proteome," bioRxiv 2020.05.14.093757; (2020) doi: https://doi.org/10.1101/2020.05.14.093757.

Custodio et al., "Selection, biophysical and structural analysis of synthetic nanobodies that effectively neutralize SARS-CoV-2," bioRxiv 2020.06.23.165415; (2020) doi: https://doi.org/10.1101/2020.06.23.165415.

Davidson et al., "Mechanism of Binding to Ebola Virus Glycoprotein by the ZMapp, ZMAb, and MB-003 Cocktail Antibodies," Journal of Virology, vol. (89.21): 10982-10992, (2015).

Dinnon, III et al., "A mouse-adapter SARS-CoV-2 model for the evaluation of COVID-19 medical countermeasures," bioRxiv 2020.05.06.081497; (2020) doi: https://doi.org/10.1101/2020.05.06.081497.

Dong et al., "Development of multi-specific humanized llama antibodies blocking SARS-CoV-2/ACE2 interaction with high affinity and avidity," Emerging Microbes & Infections, 9:1, 1034-1036, DOI: 10.1080/22221751.2020.1768806.

Ejemel et al., "IgA Mab blocks SARS-CoV-2 Spike-ACE2 interaction providing mucosal immunity," bioRxiv 2020.05.15.096719; doi: https://doi.org/10.1101/2020.05.15.096719.

Galson et al., "Deep sequencing of B cell receptor repertoires from COVID-19 patients reveal strong convergent immune signature," bioRxiv 2020.05.20.106294; doi: https://doi.org/10.1101/2020.05.20.106294.

Garde et al., "In the race to develop a coronavirus treatment, Regeneron thinks it has the inside track," STAT, pp. 1-7, Feb. 5, 2020 (2020). [https://www.statnews.com/2020/02/05/in-the-race-to-develop-a-coronavirus-treatment-regeneron-thinks-it-has-the-inside-track/].

Giron et al., "On the Interactions of the receptor-binging domain of SARS-CoV-1 and SARS-CoV-2 spike proteins with monoclonal antibodies and the receptor ACE2," Virus Research 285 (2020) 198021.

Goncalves et al., "SARS-CoV-2 mutations and where to find them: An in silico perspective of structural changes and antigenicity of the Spike protein," bioRxiv 2020.05.21.108563; (2020) doi: https://doi.org/10.1101/2020.05.21.108563.

Goyal P, Choi JJ, Pinheiro LC, et al. Clinical Characteristics of Covid-19 in New York City. N Engl J Med 2020.

Grifoni et al., "Targets of T cell responses to SARS-CoV-2 coronavirus in humans with COVID-19 disease and unexposed individuals," Cell (2020), doi: https://doi.org/10.1016/j.cell.2020.05.015.

Group RC, Horby P, Lim WS, et al. Dexamethasone in Hospitalized Patients with Covid-19—Preliminary Report. N Engl J Med 2020.

Guan WJ, Ni ZY, Hu Y, et al. Clinical Characteristics of Coronavirus Disease 2019 in China. N Engl J Med 2020;382:1708-20.

Gudbjartsson DF, Helgason A, Jonsson H, et al. Spread of SARS-CoV-2 in the Icelandic Population. N Engl J Med 2020;382:2302-15.

Hanke et al., "An alpaca nanobody neutralizes SARS-CoV-2 by blocking receptor interaction," bioRxiv 2020.06.02.130161; (2020) doi: https://doi.org/10.1101/2020.06.02.130161.

Hansen et al., "Studies in humanized mice and convalescent humans yield a SARS-CoV-2 antibody cocktail," Science, vol. (1):1-47, (2020). [Retrieved from the Internet Jun. 30, 2020: <URL: http://science.sciencemag.org].

Hansen et al., "Studies in humanized mice and convalescent humans yield a SARS-CoV-2 antibody cocktail," Science, 1-10, (2020). [Retrieved from the Internet Jul. 29, 2020: <http://science.sciencemag.org>].

Hansen et al., "Studies in humanized mice and convalescent humans yield a SARS-CoV-2 antibody cocktail," Science, pp. 1-10, (Jun. 15, 2020). [Retrieved from the Internet Jun. 23, 2020 from http://science.sciencemag.org/].

Hansen et al., supplementary materials for "Studies in humanized mice and convalescent humans yield a SARS-CoV-2 antibody cocktail," Science, pp. 1-30, (Jun. 15, 2020). [science.scieocemag.org/cgi/conrent/fu1Vscience.abd0827/DCJ].

Hansen J, Baum A, Pascal KE, et al. Studies in humanized mice and convalescent humans yield a SARS-CoV-2 antibody cocktail. Science 2020.

Heurich et al., "TMPRSS2 and ADAM17 Cleave ACE2 Differentially and Only Proteolysis by TMPRSS2 Augments Entry Driven by the Severe Acute Respiratory Syndrome Coronavirus Spike Protein," Journal of Virology, vol. 88, No. 2; Jan. 2014; p. 1293-1307.

Hsieh et al., "Structure-based design of prefusion-stabilized SARS-CoV-2 Spikes," bioRxiv 2020.05.30.125484; (2020) doi: https://doi.org/10.1101/2020.05.30.125484.

Huibin et al., "Cross-reactive Antibody Response between SARS-CoV-2 and SARS-CoV Infections," Cell Reports 31, 107725; Jun. 2, 2020. https://doi.org/10.1016/j.celrep.2020.107725.

Hulburt et al., "Structural basis for potent neurtralization of SARS-CoV-2 and role of antibody affinity maturation," bioRxiv 2020.06.12.148692; doi: https://doi.org/10.1101/2020.06.12.148692.

Huo et al., "Neutralization of SARS-CoV-2 by destruction of the prefusion Spike," bioRxiv 2020.05.05.079202; (2020) doi: https://doi.org/10.1101/2020.05.05.079202.

Interim Clinical Guidance for Management of Patients with Confirmed Coronavirus Disease (COVID-19)—Clinical Care Guidance— Updated Sep. 10, 2020. 2020. (Accessed Oct. 6, 2020).

Jacobs et al., "Neutralizing antibodies mediate virus-immune pathology of COVID-19," Science Direct, Medical Hypotheses 143; 109884, pp. 1-4. (2020).

Joyner MJ, Senefeld JW, Klassen SA, et al. Effect of Convalescent Plasma on Mortality among Hospitalized Patients with COVID-19: Initial Three-Month Experience. medRxiv 2020:2020.08.12.20169359.

(56) References Cited

OTHER PUBLICATIONS

Ju et al., "Human neutralizing antibodies elicited by SARS-CoV-2 infection," Nature https://doi.org/10.1038/s41586-020-2380-z (2020).
Ju et al., "Potent human neutralizing antibodies elicited by SARS-CoV-2 infection," bioRxiv 2020.03.21.990770; (2020) doi: https://doi.org/10.1101/2020.03.21.990770.
Keeffe et al., "A Combination of Two Human Monoclonal Antibodies Prevents Zika Virus Escape Mutations in Non-human Primates," Cell Reports, vol. (25): 1385-1394, (2018). [https://doi.org/10.1016/j.celrep.2018.10.031].
Kreer et al., "Longitudinal isolation of potent near-germline SARS-CoV-2-neutralizing antibodies from COVID-19 patients," bioRxiv 2020.06.12.146290; doi: https://doi.org/10.1101/2020.06.12.146290.
Kugelman et al., "Emergence of Ebola Virus Escape Variants in Infected Nonhuman Primates Treated with the MB-003 Antibody Cocktail," Cell Reports, vol. (12): 2111-2120, (2015). [http://dx.doi.org/10.1016/j.celrep.2015.08.038].
Lan et al., "Structure of the SARS-CoV-2 spike receptor-binding domain bound to the ACE2 receptor," Nature, vol. 581, May 14, 2020.
Larsen et al., "Afucosylated immunoglobulin G resposnes are a hallmark of enveloped virus infections and show an exacerbated phenotype in COVID-19," bioRxiv 2020.05.18.099507; doi: https://doi.org/10.1101/2020.05.18.099507.
Lavezzo E, Franchin E, Ciavarella C, et al. Suppression of a SARS-CoV-2 outbreak in the Italian municipality of Vo'. Nature 2020;584:425-9.
Lee et al., "CD-8+ T cell cross-reactivity against SARS-CoV-2 conferred by toerh coronavirus strains and influenza virus," bioRxiv 2020.05.20.107292; doi: https://doi.org/10.1101/2020.05.20.107292.
Lee S, Kim T, Lee E, et al. Clinical Course and Molecular Viral Shedding Among Asymptomatic and Symptomatic Patients With SARS-CoV-2 Infection in a Community Treatment Center in the Republic of Korea. JAMA Intern Med 2020.
Li et al., "Potent neutralization of SARS-CoV-2 in vitro and in an animal model by a human monoclonal antibody," bioRxiv 2020.05.13.093088; doi: https://doi.org/10.1101/2020.05.13.093088.
Li et al., "Potent synthetic nanobodies against SARS-CoV-2 and molecular basis for neutralization," bioRxiv 2020.06.09.143438; doi: https://doi.org/10.1101/2020.06.09.143438.
Li et al., "Repurposing host-based therapeutics to control coronavirus and influenza virus," Drug Discovery Today, vol. 24 (No. 3): 726-736, (Mar. 2019). [https://doi.org/10.1016/j.drudis.2019.01.018].
Li L, Zhang W, Hu Y, et al. Effect of Convalescent Plasma Therapy on Time to Clinical Improvement in Patients With Severe and Life-threatening COVID-19: A Randomized Clinical Trial. JAMA 2020;324:460-70.
Lotfi et al., "covid-19: Transmission, prevention, and potential therapeutic opportunities," Science Direct, Clinica Chimica Acta (508): 254-266, (2020).
Lou et al., "Cross-neutralization antibodies against SARS-cOv-2 and RBD mutations from convalescent patient antibody libraries," bioRxiv 2020.06.06.137513; doi: https://doi.org/10.1101/2020.06.06.137513.
Lui et al., "Trimeric SARS-CoV-2 Spike interacts with dimeric ACE2 with limited intra-Spike avidity," bioRxiv 2020.05.21.109157; doi: https://doi.org/10.1101/2020.05.21.109157.
Lv et al., "Structural basis for neutralization of SARS-CoV-2 and SARS-CoV by a potent therapeutic antibody," bioRxiv 2020.06.02.129098; doi: https://doi.org/10.1101/2020.06.02.129098.
Magleby R, Westblade LF, Trzebucki A, et al. Impact of SARS-CoV-2 Viral Load on Risk of Intubation and Mortality Among Hospitalized Patients with Coronavirus Disease 2019. Clin Infect Dis 2020.
Matsuyama et al., "Enhanced isolation of SARS-CoV-2 by TMPRSS2-expressing cells," PNAS, vol. 117 (No. 13), pp. 7001-7003, (Mar. 31, 2020). [<www.pnas.org/cgi/doi/10.1073/pnas.2002589117>].

Meirson et al., "Structural basis of SARS-CoV-2 spike protein induced by ACE2," bioRxiv 2020.05.24.113175; doi: https://doi.org/10.1101/2020.05.24.113175.
Meulen et al., "Human Monoclonal Antibody Combination against SARS Coronavirus: Synergy and Coverage of Escape Mutants," PLoS Medicine, vol. (3.7): 1071-1079, (2006). [www.plosmedicine.org].
Miersch et al., "Synthetic Antibodies neutralized SARS-CoV-2 infection of mammalian cells," bioRxiv 2020.06.05.137349; doi: https://doi.org/10.1101/2020.06.05.137349.
Mossel et al., "Exogenous ACE2 Expression Allows Refractory Cell Lines to Support Severe Acute Respiratory Syndrome Coronavirus Replication," Journal of Virology, vol. 79, No. 6; Mar. 2005; pp. 3846-3850.
Nascimento Jr. et al., "SARS, MERS and SARS-CoV-2 (COVI19) treatment: a patent review," Expert Opinion on Therapeutic Patents, DOI: 10.1080/13543776.2020.1772231.
Ng et al., "Pre-existing and de novo humoral immunmity to SARS-CoV-2 in humans," bioRxiv 2020.05.14.095414; doi: https://doi.org/10.1101/2020.05.14.095414.
Ni et al., "Detection of SARS-CoV-2-Specific Humoral and Cellular Immunity in COVID-19 Convalescent Individuals," Immunity 52, 1-7; Jun. 16, 2020.
Nieto et al., "Fast isolation of sub-nanomolar affinity alpaca nanobody against the Spike RBD of SARSCoV-2 by combining bacterial display and a simple single-step density gradient selection," bioRxiv, vol. (1):1-27, (2020). [https://doi.org/10.1101/2020.06.09.137935].
Noy-Porat et al., "Tiger team: a panel of human beutralizing mAbs targeting SARS-CoV-2 spike at multiple epitopes," bioRxiv 2020.05.20.106609; doi: https://doi.org/10.1101/2020.05.20.106609.
Okba et al., "Severe Acute Respiratory Syndrome Coronavirus 2-Specific Antibody Responses in Coronavirus Disease 2019 Patients," Research vol. 26, No. 7; Apr. 8, 2020.
Oran DP, Topol EJ. Prevalence of Asymptomatic SARS-CoV-2 Infection : A Narrative Review. Ann Intern Med 2020;173:362-7.
Park et al., "Spike protein binding prediction with neutralizing antibodies of SARS-CoV-2", bioRxiv 2020.02.22.951178; (2020) doi: https://doi.org/10.1101/2020.02.22.951178.
Pascal et al., "Development of Clinical-Stage Human Monoclonal Antibodies That Treat Advanced Ebola Virus Disease in Nonhuman Primates," The Journal of Infectious Diseases, vol. (218): S612-S626, (2018).
Pascal et al., "Pre-and postexposure efficacy of fully human antibodies against Spike protein in a novel humanized mouse model of MERS-CoV infection," PNAS, vol. (112 No. 28): 8738-8743, (2015). [www.pnas.org/cgi/doi/10.1073/pnas.1510830112].
Pinto et al., "Cross-neutralization of SARS-CoV-2 by a human monoclonal SARS-CoV antibody," Nature https://doi.org/10.1038/s41586-020-2349-y (2020).
Pinto et al., "Cross-neutralization of SARS-CoV-2 by a human monoclonal SARS-CoV antibody," Nature, vol. (583): 290-308, (2020). [https://doi.org/10.1038/s41586-020-2 349-y].
Poh et al., "Two linear epitopes on the SARS-CoV-2 spike protein that elicit neutralising antibodies in COVID-19 patients," Nature Communications (2020)11:2806. https://doi.org/10.1038s41467-020-16638-2.
Qiang et al., "Monoclonal Antibodies Capable of Binding SARS-CoV-2 Spike Protein Receptor Binding Motif Specifically Prevent GM-CSF Induction," bioRxiv, pp. 1-27, Sep. 4, 2020 (2020).
Ravichandran et al., "Antibody repertoire induced by SARS-CoV-2 spike protein immunogens," bioRxiv 2020.05.12.091918; doi: https://doi.org/10.1101/2020.05.12.091918.
Raybould et al., "CoV-AbDab: the Coronavirus Antibody Database," bioRxiv 2020.05.15.077313; doi: https://doi.org/10.1101/2020.05.15.077313.
Regeneron. Regeneron and Sanofi Provide Update on Kevzara (Sarilumab) Phase 3 U.S. Trial in COVID-19 Patients. 2020.
Reichert, "Coronavirus in the crosshairs, Part 1—The Antibody Society," pp. 1-7, (2020). [https://www.antibodysociety.org/coronavirus/coronavirus-in-the-crosshairs/].

(56) References Cited

OTHER PUBLICATIONS

Reichert, "Coronavirus in the crosshairs, Part 4: Antibody therapeutics—The Antibody Society," pp. 1-10, (2020). [https://www.antibodysociety.org/covid-19/coronavirus-in-the-crosshairs-part-4-antibody-therapeutics/].

Richardson S, Hirsch JS, Narasimhan M, et al. Presenting Characteristics, Comorbidities, and Outcomes Among 5700 Patients Hospitalized With COVID-19 in the New York City Area. JAMA 2020.

Robbiani et al., "Convergent antibody responses to SARS-CoV-2 in convalescent individuals," Nature https://doi.org/10.1038/s41586-020-2456-9 (2020).

Robbiani et al., "Convergent Antibody Responses to SARS-CoV-2 Infection in Convalescent Individuals," bioRxiv 2020.05.13. 092619; (2020) doi: https://doi.org/10.1101/2020.05.13.092619.

Roche. Roche Provides an Update on the Phase III COVACTA Trial of ACTEMRA/ROACTEMRA in Hospitalized Patients with Severe COVID-19 Associated Pneumonia. 2020.

Rockx et al., "Escape from Human Monoclonal Antibody Neutralization Affects in Vitro and In Vivo Fitness of Severe Acute Respiratory Syndrome Coronavirus," The Journal of Infectious Diseases, vol. (201): 946-955, (2010). [DOI: 10.1086/651022].

Rogers et al., "Isolation of potent SARS-CoV-2 neutralizing antibodies and protection from disease in a small animal model," Science 10.1126/scienec.abc7520 (2020).

Rogers et al., "Rapid isolation of potent SARS-CoV-2 neutralizing antibodies and protection in a small animal model," bioRxiv 2020. 05.11.088674; doi: https://doi.org/10.1101/2020.05.11.088674.

Rosas I, Bräu N, Waters M, et al. Tocilizumab in Hospitalized Patients With COVID-19 Pneumonia. medRxiv 2020:2020.08.27. 20183442.

Rouet et al., "Potent SARS-CoV-2 binding and neutralization through maturation of iconic SARS-CoV-1 antibodies," bioRxiv, pp. 1-52, (2020). [https://doi.org/10.1101/2020.12.14.422791].

Seydoux et al., "Analysis of a SARS-CoV-2 infected individual reveals development of potent neutralizing antibodies to distinct epitopes with limited somatic mutation ," Immunity 4384; https://doi.org/10.1016/j.immuni.2020.06.001.

Seydoux et al., "Characterization of neutralizing antibodies from a SARS-CoV-2 infected individual," bioRxiv 2020.05.12.091298; doi: https://doi.org/10.1101/2020.05.12.091298.

Shen et al., "TMPRSS2: A potential target for treatment of influenza virus and coronavirus infections," Biochimie at ScienceDirect, vol. 142: 1-10, (2017). [http://dx.doi.org/10.1016/j.biochi.2017.07.016].

Shi et al., "A Human neutralizing antibody targets the receptor binding cite of SARS-CoV-2," Nature https://doi.org/10.1038/s41586-020-2381-y (2020).

Simoes EAF, Forleo-Neto E, Geba GP, et al. Suptavumab for the Prevention of Medically Attended Respiratory Syncytial Virus Infection in Preterm Infants. Clin Infect Dis 2020.

Stave et al., "Antibody and Antigen Contact Residues Define Epitope and Paratope Size and Structure," The Journal of Immunology, vol. (191): 1428-1435, (2013). [www.jimmunol.org/cgi/doi/10.4049/jimmunol.1203198].

Supasa et al., "Reduced neutralization of SARS-CoV-2 B.1.1.7 variant by convalescent and vaccine sera," Cell, vol. (184): 2201-2211, (2021). Https://doi.org/10.1016/j.cell.2021.02.033].

Suthar et al., "Rapid generation of neutralizing antibody responses in COVID-19 patients," Cell Reports Medicine, 1-36 pages (2020). [https://doi.org/10.1016/j.xcrm.2020.100040].

Tai et al., "Identification of SARS-CoV RBD-targeting monoclonal antibodies with crossreactive or neutralizing activity against SARS-CoV-2," Antiviral Research, Science Direct, vol. (179):1-6, (2020). [www.elsevier.com/locate/antiviral].

Tenforde MW, Kim SS, Christopher J. Lindsell, et al. Symptom Duration and Risk Factors for Delayed Return to Usual Health Among Outpatients with COVID-19 in a Multistate Health Care Systems Network—United States, Mar.-Jun. 2020. MMWR Morb Mortal Wkly Rep 2020;60:993-8.

Teng et al., "Systemic Effects of Missense Mutations on SARS-CoV-2 Spike Glycoprotein Stability and Receptor Binding Affinity," bioRxiv, vol. (1):1-36, (2020). [https://doi.org/10.1101/2020.05.21.109835].

Tian et al., "Potent binding of 2019 novel coronavirus spike protein by a SARS coronavirus-specific human monoclonal antibody," Emerging Microbes & Infections, vol. (17): 647-649, Feb. 17, 2020 (2020).

U.S. Appl. No. 16/912,678, Notice of Allowance mailed Jul. 29, 2020.

U.S. Appl. No. 16/996,297, Non-Final Office Action mailed Dec. 8, 2020.

U.S. Appl. No. 16/996,297, Notice of Allowance mailed Jan. 25, 2021.

U.S. Appl. No. 17/021,286, Non-Final Office Action mailed Dec. 23, 2020.

U.S. Appl. No. 17/021,286, Notice of Allowance mailed Jan. 22, 2021.

Vandergaast et al., "Development and validation of IMMUNO-COVTM: a high-throughput clinical assay for detecting antibodies that neutralize SARS-CoV-2," bioRxiv, pp. 1-32, (2020). [https://doi.org/10.1101/2020.05.26.117549].

Walker et al., "Passive immunotherapy of viral infections: 'super-antibodies' enter the fray," Nature Reviews at Immunology, vol. 18: 297-308, (2018). [doi:10.1038/nri.2017.148].

Wan et al., "Human IgG cell neutralizing monoclonal antibodies block SARS-CoV-2 infect," bioRxiv, vol. (1):1-25, (2020). [https://doi.org/10.1101/2020.05.19.104117].

Wan et al., "Human IgG cell neutralizing monoclonal antibodies block SARS-CoV-2 infection," bioRxiv, pp. 1-28, (May 21, 2020). [doi:https://doi.org/10.1101/2020.05.19.104117].

Wang et al., "A human monoclonal antibody blocking SARS-CoV-2 infection," Supplemental information, 1-13 pages (2020).

Wang et al., "A human monoclonal antibody blocking SARS-CoV-2 infection," Nature Communications, 1-7, (2020). [https://doi.org/10.1038/s41467-020-16256-y | www.nature.com/naturecommunications].

Wang et al., "A human monoclonal antibody blocking SARS-CoV-2 infection," bioRxiv, pp. 1-24, (Mar. 12, 2020). [doi:https://doi.org/10.1101/2020.03.11.987958].

Wang et al., "E484K mutation in SARS-CoV-2 Rbd enhances binding affinity with hACE2 but reduces interactions with neutralizing antibodies and nanobodies: Binding free energy calculation studies," bioRxiv, pp. 1-18, (2021).

Wang et al., "Importance of Neutralizing Monoclonal Antibodies Targeting Multiple Antigenic Sites on the Middle East Respiratory Syndrome Coronavirus Spike Glycoproein To Avoid Neutralization Escape," Vaccines and Antiviral Agents, Journal of Virology, vol. (92) No. (10): 1-21, (May 2018). [Retrieved from the Internet May 5, 2020: <URL: http://jvi.asm.org>].

Wang et al., "SARS-CoV-2 Neutralizing Antibody Responses Are More Robust in Patients with Severe Disease," bioRxiv, vol. (1): 1-9, (2020). [https://doi.org/10.1101/2020.06.13.150250].

Wang et al., "Structural and Functional Basis of SARS-CoV-2 Entry by Using Human ACE2," Cell, vol. (181):894-904, (2020). [https://doi.org/10.1016/j.cell.2020.03.045].

Watanabe et al., "Site-specific glycan analysis of the SARS-CoV-2 spike," Science, vol. (1): 1-9, (2020). [Retrieved from the Internet May 13, 2020: <URL: http://science.sciencemag.org>; Y. Watanabe et al., Science 10.1126/science.abb9983 (2020)].

Watanabe et al., "Vulnerabilities in coronavirus glycan shields despite extensive glycosylation," Nature Communications, vol. (11):1-10, (2020). [https://doi.org/10.1038/s41467-020-16567-0].

Wec et al., "Broad neutralization of SARS-related viruses by human monoclonal antibodies," Science, vol. (1):1-12, (2020). [Retrieved from the Internet Jun. 17, 2020: <URL: http://science.sciencemag.org>; A. Z. Wec et al., Science 10.1126/science.abc7424 (2020)].

Wec et al., "Broad neutralization of SARS-related viruses by human monoclonal antibodies," Science, vol. (1):1-30, (2020). [science.sciencemag.org/cgi/content/full/science.abc7424/DC1>].

Wec et al., "Broad sarbecovirus neutralizing antibodies define a key site of vulnerability on the SARS-CoV-2 spike protein," bioRxiv, 1-18, (2020). [https://doi.org/10.1101/2020.05.15.096511].

(56) References Cited

OTHER PUBLICATIONS

WHO Director-General's Opening Remarks at the Media Briefing on COVID-19—Mar. 11, 2020. 2020. (Accessed Jun. 9, 2020, at https://www.who.int/dg/speeches/detail/who-director-general-s-opening-remarks-at-the-media-briefing-on-covid-19—11-march-2020.).
WIPO Application No. PCT/US2020/039707, PCT International Search Report and Written Opinion of the International Searching Authority mailed Nov. 9, 2020.
WIPO Application No. PCT/US2020/039707, PCT Third Party Observation Communication mailed May 2, 2022.
WIPO Application No. PCT/US2021/034187, PCT International Search Report and Written Opinion of the International Searching Authority mailed Nov. 2, 2021.
WIPO Application No. PCT/US2021/035556, PCT International Search Report and Written Opinion of the International Searching Authority mailed Sep. 10, 2021.
WIPO Application No. PCT/US2022/018918, PCT International Search Report and Written Opinion of the International Searching Authority mailed Jun. 17, 2022.
Wolfel R, Corman VM, Guggemos W, et al. Virological assessment of hospitalized patients with COVID-2019. Nature 2020;581:465-9.
Wrapp et al., "Cryo-EM structure of the 2019-nCoV spike in the prefusion conformation," Science, vol. (367):1260-1263, (2020). [Retrieved from the Internet Jul. 29, 2020: <http://science.sciencemag.org>].
Wrapp et al., "Structural Basis for Potent Neutralization of Betacoronaviruses by Single-Domain Camelid Antibodies," Cell, vol. (181):1-12, (2020). [https://doi.org/10.1016/j.cell.2020.04.031].
Wu et al., "A noncompeting pair of human neutralizing antibodies block COVID-19 virus binding to its receptor ACE2," Science, 1-8, (2020). [Retrieved from the Internet May 14, 2020: <URL: http://science.sciencemag.org>; Y. Wu et al., Science 10.1126/science.abc2241 (2020)].
Wu et al., "Fully human single-domain antibodies against SARS-CoV-2," bioRxiv 2020.03.30.015990; (2020) doi: https://doi.org/10.1101/2020.03.30.015990.
Wu et al., "Identification of Human Single-Domain Antibodies against SARS-CoV-2," Cell Host & Microbe, vol. (27): 1-8, (2020). [https://doi.org/10.1016/j.chom.2020.04.023].
Wu et al., "Identification of Human Single-Domain Antibodies against SARS-CoV-2," Cell Host & Microbe, vol. (27):S 891-898, (2020).
Yi et al., "Key residues of the receptor binding motif in the spike protein of SARS-CoV-2 that interact with ACE2 and neutralizing antibodies," Cellular & Molecular Immunology, 1-10, (2020).
Yi et al., "Key residues of the receptor binding motif in the spike protein of SARS-CoV-2 that interact with ACE2 and neutralizing antibodies," Cellular & Molecular Immunology, vol. (17): 621-630, (2020). [www.nature.com/cmi].
Yu et al., "DNA vaccine protection against SARS-CoV-2 in rhesus macaques," Science, 1-11, (2020). [Retrieved from the Internet May 22, 2020: <URL: http://science.sciencemag.org>; J. Yu et al., Science 10.1126/science.abc6284 (2020)].
Yuan et al., "A highly conserved cryptic epitope in the receptor binding domains of SARS-CoV-2 and SARS-CoV," Science, vol. (368):630-633, (2020). [Retrieved from the Internet May 20, 2020: <URL: http://science.sciencemag.org>].
Yuan et al., "Isolation of and Characterization of Neutralizing Antibodies to Covid-19 from a Large Human Naïve scFv Phage Display Library," bioRxiv, 1-15, (2020). [https://doi.org/10.1101/2020.05.19.104281].
Yuan et al., "Structural and functional ramifications of antigenic drift in recent SARS-CoV-2 variants," bioRxiv, pp. 1-50, (2021). [https://doi.org/10.1101.2021.02.16.430500].
Zhang et al., "Immunization with the receptor-binding domain of SARS-CoV-2 elicits antibodies cross-neutralizing SARS-CoV-2 and SARS-CoV without antibody-dependent enhancement," bioRxiv, 1-33, (2020). [https://doi.org/10.1101/2020.05.21.107565].
Zhang et al., "The use of anti-inflammatory drugs in the treatment of people with severe coronavirus disease 2019 (COVID-19): The Perspectives of clinical immunologists from China," Clinical Immunology at ScienceDirect, vol. 214, (2020). [https://doi.org/10.1016/j.clim.2020.108393].
Zheng et al., "Isolation of a human monoclonal antibody specific for the receptor binding domain of SARS-CoV-2 using a competitive phage biopanning strategy," Antibody Therapeutics, vol. (3.2):95-100, (2020). [Retrieved from the Internet May 27, 2020: <URL: https://academic.oup.com/abt/article-abstract/3/2/95/5827124>].
Zheng et al., "Novel antibody epitopes dominate the antigenicity of spike glycoprotein in SARS-CoV-2 compared to SARS-CoV," Cellular & Molecular Immunology, vol. (17):536-538, (2020). [https://doi.org/10.1038/s41423-020-0385-z].
Zhou et al., "A pneumonia outbreak associated with a new coronavirus of probable bat origin," Nature, vol. (579): 270-289, (2020). [https://doi.org/10.1038/s41586-020-2012-7].
Zhou et al., "Evidence of escape of SARS-CoV-2 variant B.1.351 from natural and vaccine-induced sera," Cell, vol. (189): 2348-2361, (2021). [https://doi.org/10.1016/j.cell.2021.02.037].
Zhu et al., "Safety, tolerability, and immunogenicity of a recombinant adenovirus type-5 vectored COVID-19 vaccine: a dose-escalation, open-label, non-randomised, first-in-human trial," the lancet, vol. (395): 1845-1854, (May 22, 2020). [https://doi.org/10.1016/ 50140-6736(20)31208-3].
Zost et al., "Potently neutralizing human antibodies that block SARS-CoV-2 receptor binding and protect animals," bioRxiv, 1-35, (2020). [https://doi.org/10.1101/2020.05.22.111005].
Zost et al., "Rapid isolation and profiling of a diverse panel of human monoclonal antibodies targeting the SARS-CoV-2 spike protein," bioRxiv, 1-48, (2020). [https://doi.org/10.1101/2020.05.12.091462].
U.S. Appl. No. 63/004,312, filed Apr. 2, 2020.
U.S. Appl. No. 63/014,687, filed Apr. 23, 2020.
U.S. Appl. No. 63/025,949, filed May 15, 2020.
U.S. Appl. No. 63/030,260, filed May 26, 2020.
U.S. Appl. No. 63/033,198, filed Jun. 1, 2020.
U.S. Appl. No. 63/034,348, filed Jun. 3, 2020.
U.S. Appl. No. 63/034,865, filed Jun. 4, 2020.
U.S. Appl. No. 63/036,956, filed Jun. 9, 2020.
U.S. Appl. No. 63/038,274, filed Jun. 12, 2020.
U.S. Appl. No. 63/043,336, filed Jun. 24, 2020.
U.S. Appl. No. 16/912,678, filed Jun. 25, 2020, now U.S. Pat. No. 10,787,501.
PCT/US2020/039707, Jun. 25, 2020, WO 2021/045836.
U.S. Appl. No. 63/060,592, filed Aug. 3, 2020.
U.S. Appl. No. 63/062,961, filed Aug. 7, 2020.
U.S. Appl. No. 63/065,799, filed Aug. 14, 2020.
U.S. Appl. No. 16/996,297, filed Aug. 18, 2020, now U.S. Pat. No. 10,975,139.
U.S. Appl. No. 17/021,286, filed Sep. 15, 2020, now U.S. Pat. No. 10,954,289.
U.S. Appl. No. 63/084,881, filed Sep. 29, 2020.
U.S. Appl. No. 63/085,066, filed Sep. 29, 2020.
U.S. Appl. No. 63/089,399, filed Oct. 8, 2020.
U.S. Appl. No. 63/090,690, filed Oct. 12, 2020.
U.S. Appl. No. 63/094,133, filed Oct. 20, 2020.
U.S. Appl. No. 63/093,888, filed Oct. 20, 2020.
U.S. Appl. No. 63/105,779, filed Oct. 26, 2020.
U.S. Appl. No. 63/106,696, filed Oct. 28, 2020.
U.S. Appl. No. 63/112,140, filed Nov. 10, 2020.
U.S. Appl. No. 63/112,143, filed Nov. 10, 2020.
U.S. Appl. No. 63/116,773, filed Nov. 20, 2020.
U.S. Appl. No. 63/119,593, filed Nov. 30, 2020.
U.S. Appl. No. 63/120,065, filed Dec. 1, 2020.
U.S. Appl. No. 63/124,980, filed Dec. 14, 2020.
U.S. Appl. No. 63/131,627, filed Dec. 29, 2020.
U.S. Appl. No. 63/141,423, filed Jan. 25, 2021.
U.S. Appl. No. 63/141,952, filed Jan. 26, 2021.
U.S. Appl. No. 63/141,956, filed Jan. 26, 2021.
U.S. Appl. No. 63/142,471, filed Jan. 27, 2021.
U.S. Appl. No. 63/142,472, filed Jan. 27, 2021.
U.S. Appl. No. 63/144,789, filed Feb. 2, 2021.

(56) References Cited

OTHER PUBLICATIONS

U.S. Appl. No. 63/145,389, filed Feb. 3, 2021.
U.S. Appl. No. 63/150,978, filed Feb. 18, 2021.
U.S. Appl. No. 63/157,556, filed Mar. 5, 2021.
U.S. Appl. No. 63/159,437, filed Mar. 10, 2021.
U.S. Appl. No. 63/162,504, filed Mar. 17, 2021.
U.S. Appl. No. 63/162,996, filed Mar. 18, 2021.
U.S. Appl. No. 63/164,488, filed Mar. 22, 2021.
U.S. Appl. No. 63/165,654, filed Mar. 24, 2021.
U.S. Appl. No. 63/166,187, filed Mar. 25, 2021.
U.S. Appl. No. 63/173,468, filed Apr. 11, 2021.
U.S. Appl. No. 63/185,301, filed May 6, 2021.
U.S. Appl. No. 63/186,029, filed May 7, 2021.
PCT/US2021/034187, May 26, 2021, WO 2021/242815.
PCT/US2021/035556, Jun. 2, 2021, WO 2021/247779.
U.S. Appl. No. 17/337,396, filed Jun. 2, 2021, US2021-0395345.
U.S. Appl. No. 63/221,846, filed Jul. 14, 2021.
U.S. Appl. No. 63/245,020, filed Sep. 16, 2021.
U.S. Appl. No. 63/286,514, filed Dec. 6, 2021.
U.S. Appl. No. 63/289,126, filed Dec. 13, 2021.
U.S. Appl. No. 63/289,419, filed Dec. 14, 2021.
U.S. Appl. No. 63/291,328, filed Dec. 17, 2021.
U.S. Appl. No. 63/301,002, filed Jan. 19, 2022.
U.S. Appl. No. 63/306,909, filed Feb. 4, 2022.
PCT/US2022/018918, Mar. 4, 2022.
U.S. Appl. No. 63/354,632, filed Jun. 22, 2022.
PCT/US2022/036950, Jul. 13, 2022.
U.S. Appl. No. 17/207,524, filed Mar. 19, 2021.
Almagro et al., "Humanization of Antibodies," Frontiers in Bioscience, vol. (13): 1619-1633, (2008).
Baum et al., "REGN-CoV2 antibodies prevent and treat SARS-CoV-2 infection in rhesus macaques and hamsters," Science, vol. 370, No. 6520:1110-1115, (2020).
Barnes et al., "SARS-CoV-2 neutralizing antibody structures inform therapeutic strategies," Nature, vol. 588, No. 7839, pp. 682-687, (2020). [Retrieved from the Internet: <URL: http://www.nature.com/articles/s41586-020-2852-1>].
Bruel et al., "Serum neutralization of SARS-CoV-2 Omicron sublineages BA.1 and BA.2 in patients receiving monoclonal antibodies," Nature Medicine, Nature Publishing Group US, vol. (28) No. 6: 1297-1302, (2022). [Retrieved from the Internet Mar. 23, 2022; ISSN: 1078-8956, DOI:10.1038/S41591-022-01792-5].
Deeks et al., "Casirivimab/Imdevimab: First Approval," DRUGS, vol. (81) No. 17: 2047-2055, (2021). [URL: https://link.springer.com/article/10.1007/s40265-021-01620-z/fulltext.html].
Deshpande et al., "Epitope Classification and RBD Binding Properties of Neutralizing Antibodies Against SARS-CoV-2 Variants of Concern," Frontiers in Immunology, vol. 12, Jun. 4, 2021; 30 pages.
Edwards et al., "The Remarkable Flexibility of the Human Antibody Repertoire; Isolation of Over One Thousand Different Anibodies to a Single Protein, BLyS,"JMB, vol. (334): 103-118, (2003). [doi:10.1016/jmb.2003.09.054>].
European Medicines Agency (EMA), "Assesment report Regeneron Ireland DAC use of casirivimab and imdevimab for the treatment of COVID-19," Chapter 2.2, (2021). [Retrieved from the Internet URL:https://www.ema.europa.eu/en/documents/referral/regn-cov2-antibody-combination-casirivimab/imdevimab-covid19-article-53-procedure-assessment-report_en.pdf].
Jones et al., "LY-CoV555, a rapidly isolated potent neutralizing antibody, provides protection in a non-human primate model of SARS-CoV-2 infection," bioRxiv, Oct. 9, 2020; 29 pages. [Retrieved from the Internet May 23, 2021: <URL: http://www.biorxiv.org/content/10.1101/2020.09.30.318972x3>].
Kussie et al., "A Single engineered amino acid substitution changes antibody fine specificity," The Journal of Immunology, vol. (152) 1: 146-152, (1994). [https://doi:org/10.4049/jimmunol. 152.1.146].
Lagadinou et al., "Prognosis of COVID-19: Changes in laboratory parameters," Le Infezioni in Medicina, Suppl. 1, p. 89-95 (2020).
Martinez-Navio et al., "Long-Term Delivery of an Anti-SIV Monoclonal Antibody With AAV," Frontiers in Immunology, vol. 11(Article 449): 1-9, (Mar. 2020). [doi: 10.3389/fimmu.2020.00449].
Mazzaferri et al., "Exploratory data on the clinical efficacy of monoclonal antibodies against SARS-DOV-2 Omicron Variant of Concern," medRxiv, pp. 1-21, (2022). [Retrieved from the Internet Jun. 27, 2022: <URL: http://www.medrxiv.org/content/10.1101/2022.05.06.22274613v1>].
Rudikoff et al., "Single amino acid substitution altering antigen-binding specificity," Proc. Natl. Acad. Sci. USA, vol. 79:1979-1983, (Mar. 1982).
Tatham et al., "Lack of Ronapreve (REGN-COV; casirivimab and imdevimab) virological efficacy against the SARS-COV-2 Omicron variant (B.1.1.529) in K18-hACE2 mice," bioRxiv, (2022). [Retrieved from the Internet Feb. 14, 2023 URL:https://www.biorxiv.org/content/10.1101.2022.01.23.477397v1].
Tortorici et al., "Ultrapotent human antobodies protect against SARS-CoV-2 challenge via multiple mechanisms," Science, vol. 370:950-957, (2020). [Retrieved from the Internet Apr. 14, 2021: <URL: http://www.science.sciencemag.org/content/sci/370/6519/950.full.pdf>].
Uraki et al., "Characterization and antiviral susceptibility of SARS-COV-2 Omicron BA.2," Nature, Nature Publishing Group UK, London, vol. (607) No. 7917: 119-127, (2022). [Retrieved from the Internet May 16, 2022, ISSN: 0028-0836, DOI: 10.1038/S41586-022-04856-1].
U.S. Appl. No. 17/207,524, Requirement for Restriction/Election mailed Sep. 7, 2022.
U.S. Appl. No. 17/337,396, Non-Final Office Action mailed Nov. 14, 2022.
U.S. Appl. No. 17/207,524, Non-Final Office Action mailed Nov. 22, 2022.
U.S. Appl. No. 17/207,524, Notice of Allowance mailed Mar. 30, 2023.
U.S. Appl. No. 17/337,396, Non-Final Office Action mailed Apr. 11, 2023.
U.S. Appl. No. 17/337,396, Final Office Action mailed Oct. 4, 2023.
U.S. Appl. No. 17/337,396, Notice of Allowance mailed Jan. 29, 2024.
U.S. Appl. No. 18/216,118, Non-Final Office Action mailed Apr. 16, 2024.
U.S. Appl. No. 18/216,118, Non-Final Office Action mailed Aug. 2, 2024.
Van Blargan et al., "A potently neutralizing SARS-CoV-2 antibody inhibits variants of concern by utilizing unique binding residues in a highly conserved epitope," Immunity, vol. 54, No. 10, pp. 2399-2416, (2021).
Wang et al., "Evaluation of the efficacy and safety of intravenous remdesivir in adult patients with severe COVID-19: study protocol for a phase 3 randomized, double-blind, placebo-controlled, multicentre trial," Trials, vol. 21:422, 11 pages, (2020). DOI: https://doi.org/10.1186/s13063-020-04352-9.
Wiegang et al., "The Rise and Fall of SARS-COV-2 Variants and Ongoing Diversification of Omicron," Viruses, vol. (14) No. 9 : p. 2009, (2022). [URL: http://www.mdpi.com/1999-4915/14/9/20/09>].
WIPO Application No. PCT/US2022/036950, PCT International Search Report and Written Opinion of the International Searching Authority mailed Nov. 29, 2022; 30 pages.
WIPO Application No. PCT/US2022/049069, PCT Invitation to Pay Additional Fees and, where Applicable, Protest Fee of the International Searching Authority mailed Mar. 2, 2023.
WIPO Application No. PCT/US2022/049069, PCT International Search Report and Written Opinion of the International Searching Authority mailed Apr. 26, 2023.
WIPO Application No. PCT/US2022/036950, PCT Invitation to Pay Additional Fees, and Where Applicable, Protest Fee, mailed Oct. 7, 2022.
Weinreich et al., "REGN-CoV, a Neutralizing Antibody Cocktail, in Outpatients with Covid-19," The New England Journal of Medicine, vol. 384(3):238-251, (2020). [Retrieved from the Internet: <URL: http://www.nehm.org/doi/pds/10.1056/NEJMao2035002?articleTools=true>].

(56) References Cited

OTHER PUBLICATIONS

Zhao et al., "Isolation and identification of an scFv antibody against nucleocapsid protein of SARS-CoV," Microbes and Infection 9 (2007) 1026-1033. [doi:10.1016/j.micinf.2007.04.008].

Zhiqiang Ku et al., "Molecular determinants and mechanism for antibody cocktail preventing SARS-CoV-2 escape," Nature Communications, vol. 12(469), 13 pages (2021). [Retrieved from the Internet Apr. 14, 2022 <URL: http://www.nature.com.articles/s41467-020-20789-7.pdf>].

\* cited by examiner

| REGN w/COMP mAb ID | RBD.mmh monomer captured | mAb-1 bound (nm) | mAb-1 | REGN14312 | REGN14256 | REGN14255 | REGN10933 | REGN14258 | REGN14257 | REGN14285 | REGN14286 | REGN14280 | REGN14282 |
|---|---|---|---|---|---|---|---|---|---|---|---|---|---|
| REGN14312 | 0.55±0.02 | 1.20±0.06 | mAb-24 | 0.01 | 0.11 | 0.36 | 0.98 | 0.94 | 0.02 | 0.04 | 0.04 | 0.15 | 0.03 |
| REGN14256 | 0.52±0.01 | 1.04±0.03 | mab-10 | 0.09 | 0.01 | 0.89 | 0.05 | 0.14 | 0.1 | 0.1 | 0.14 | 0.14 | 0.11 |
| REGN14255 | 0.54±0.01 | 1.05±0.05 | mab-9 | 0.07 | 0.81 | -0.02 | 0.03 | 0.14 | 0.11 | 0.1 | 0.12 | 0 | 0.09 |
| REGN10933 | 0.54±0.02 | 1.20±0.09 | mAb-28 | 0.06 | 0.8 | 0.88 | 0.04 | 0.16 | 0.12 | 0.11 | 0.15 | -0.01 | 0.08 |
| REGN14258 | 0.56±0.01 | 1.14±0.04 | mab-12 | 0 | 0.94 | 0.43 | -0.01 | 0.05 | 0.01 | 0.06 | 0.05 | -0.01 | 0.02 |
| REGN14257 | 0.57±0.02 | 1.07±0.03 | mab-11 | 0.07 | 0.91 | 0.06 | 0.04 | 0.1 | 0.03 | 0.07 | 0.1 | -0.01 | 0.08 |
| REGN14285 | 0.54±0.01 | 1.08±0.05 | mAb-19 | 0.01 | 0.58 | 0.01 | 0.03 | 0.04 | 1.11 | 0.01 | 0.02 | -0.05 | 0.04 |
| REGN14286 | 0.53±0.02 | 1.09±0.05 | mAb-20 | 0.01 | 0.27 | -0.02 | 0.01 | 0.01 | 0.04 | 0 | 0 | -0.03 | 0.02 |
| REGN14280 | 0.57±0.02 | 1.23±0.04 | mAb-14 | 0.01 | 0.07 | 0.08 | 0.01 | 0.02 | 0.01 | 0.02 | 0.02 | 0.01 | 0.03 |
| REGN14282 | 0.59±0.02 | 1.22±0.05 | mab-16 | 0.01 | 0.07 | 0.06 | 0 | 0.27 | 0.01 | 0.02 | 0.04 | 0.11 | 0.03 |
| REGN14281 | 0.60±0.02 | 1.23±0.05 | mab-15 | 0.02 | 0.08 | 0.06 | 0.02 | 1.06 | 0.03 | 0.03 | 0.05 | 0.09 | 0.03 |

FIG. 1

| REGN Nr/COMP mAb ID | REGN 14281 | REGN 13457 | REGN 13458 | REGN 13459 | REGN 14313 | REGN 14283 | REGN 10887 | REGN 14289 | REGN 14294 | REGN 14235 | REGN 14234 | REGN 14247 | REGN 14260 | REGN 14315 |
|---|---|---|---|---|---|---|---|---|---|---|---|---|---|---|
| REGN14312 | 0.03 | 0.81 | 0.91 | 0.93 | 1.03 | 0.78 | 0.03 | 0.89 | 0.97 | 0.68 | 1.06 | 1.23 | 0.01 | 0 |
| REGN14256 | 0.71 | 0.82 | 0.81 | 0.9 | 0.94 | 0.81 | 0.88 | 0.85 | 0.69 | 0.44 | 0.96 | 1 | 0.87 | 0.88 |
| REGN14255 | 0.83 | 0.87 | 0.88 | 0.96 | 0.95 | 0.84 | 0.97 | 0.92 | 0.82 | 0.61 | 0.96 | 1.02 | 0.91 | 0.91 |
| REGN10993 | 0.83 | 0.76 | 0.76 | 0.84 | 0.94 | 0.78 | 0.86 | 0.84 | 0.84 | 0.61 | 0.93 | 0.99 | 0.81 | 0.92 |
| REGN14258 | 0.95 | 0.91 | 0.93 | 0.99 | 0.92 | 0.42 | 1 | 0.77 | 0.93 | 0.64 | 1.08 | 1.13 | 0.74 | 1.11 |
| REGN14257 | 0.83 | 0.76 | 0.84 | 0.8 | 0.13 | 0.09 | 0.86 | 0.06 | 0.82 | 0.52 | 1.07 | 1.14 | 0.07 | 1.12 |
| REGN14285 | 0.81 | 0.06 | 0.05 | 0.07 | 0.08 | 0.02 | 0.08 | -0.01 | 0.8 | 0.38 | 1 | 1.05 | 0 | 0.08 |
| REGN14286 | 0.75 | 0.01 | 0.01 | 0.03 | 0.04 | 0 | 0.01 | -0.02 | 0.75 | 0.23 | 1.03 | 1.08 | -0.02 | 1.01 |
| REGN14280 | 0.08 | 0.03 | 0.04 | 0.04 | 0.09 | 0.03 | 0.05 | 0.01 | 0.88 | 0.45 | 1.05 | 1.08 | 0.75 | 0.98 |
| REGN14282 | 0.03 | 0.01 | 0.03 | 0.04 | 0.05 | 0.01 | 0.03 | 0.01 | 1.01 | 0.54 | 1.19 | 1.35 | 0.01 | 0 |
| REGN14281 | 0.03 | 0.01 | 0.01 | 0.03 | 0.05 | 0.04 | 0.04 | 0.02 | 0.98 | 0.38 | 1.17 | 1.33 | 0.02 | 0.01 |

FIG. 1 Continued

| REGN w/COMP mAb ID | REGN 14230 | REGN 14284 | REGN 10985 | | REGN 14232 | REGN 14292 | REGN 14314 |
|---|---|---|---|---|---|---|---|
| REGN14312 | 0.98 | 0.8 | 1.28 | | 0.1 | 0.01 | 0.81 |
| REGN14256 | 0.86 | 0.52 | 0.24 | -0.02 | 0.08 | 0.14 | 0.03 |
| REGN14255 | 0.88 | 0.72 | 1.15 | -0.01 | 0.11 | 0 | 0.65 |
| REGN10933 | 0.84 | 0.66 | 1.14 | -0.01 | 0.1 | -0.01 | 0.51 |
| REGN14258 | 0.99 | 0.78 | 1.15 | -0.02 | 0.09 | -0.03 | 0.96 |
| REGN14257 | 1 | 0.8 | 1.09 | 0 | 0.07 | -0.01 | 0.21 |
| REGN14285 | 0.87 | 0.48 | 1.07 | 0 | 0.01 | -0.05 | 0.64 |
| REGN14286 | 0.87 | 0.2 | 1.1 | -0.06 | 0.01 | -0.04 | 0.03 |
| REGN14280 | 0.91 | 0.69 | 1.1 | -0.04 | 0.05 | -0.02 | 0.33 |
| REGN14282 | 1.05 | 0.79 | 1.26 | -0.03 | 0.06 | -0.01 | 0.06 |
| REGN14281 | 1.07 | 0.87 | 1.26 | -0.02 | 0.07 | 0 | 0.54 |

FIG. 1 Continued

| REGN Nr/COMP mAb ID | RBD.mmh monomer captured | mAb-1 bound (nm) | mAb-1 | REGN 14312 | REGN 14256 | REGN 14255 | REGN 10933 | REGN 14258 | REGN 14257 | REGN 14285 | REGN 14286 | REGN 14280 | REGN 14282 |
|---|---|---|---|---|---|---|---|---|---|---|---|---|---|
| REGN13457 | 0.60±0.01 | 1.18±0.04 | mAb-1 | 1.08 | 0.04 | 0.07 | 1.1 | 0.06 | 0.04 | 0.03 | 0.06 | 0.01 | 1.14 |
| REGN13458 | 0.58±0.01 | 1.14±0.02 | mAb-2 | 1.06 | 0.01 | 0.04 | 1.08 | 0.02 | 0.01 | 0.01 | 0.03 | 0 | 1.09 |
| REGN13459 | 0.56±0.01 | 1.09±0.02 | mAb-3 | 1.05 | 0.01 | 0.03 | 1.05 | 0.02 | 0.01 | 0 | 0.02 | -0.01 | 1.08 |
| REGN14313 | 0.58±0.03 | 1.16±0.02 | mAb-25 | 0.94 | 0.03 | 0.03 | 1.1 | 0.01 | 0.01 | 0.01 | 0.01 | 0 | 1.01 |
| REGN14283 | 0.55±0.01 | 1.08±0.06 | mAb-17 | 0.7 | 0.04 | 0.04 | 0.98 | 0.05 | 0.12 | 0.06 | 0.05 | -0.02 | 0.73 |
| REGN10987 | 0.58±0.03 | 1.20±0.07 | mAb-29 | 1.03 | 0.93 | 1.05 | 0.95 | 0.97 | 0.95 | -0.03 | -0.01 | -0.06 | -0.02 |
| REGN14289 | 0.58±0.02 | 1.15±0.06 | mAb-21 | 1.17 | 1.06 | 1.11 | 0.05 | 0.07 | 0.96 | 0.09 | 0.13 | 0.09 | 0.37 |
| REGN14294 | 0.56±0.02 | 1.04±0.06 | mAb-23 | 1.23 | 1.05 | 1.08 | 0.18 | 0.22 | 0.99 | 1.04 | 1.08 | 1.1 | 1.15 |
| REGN14235 | 0.59±0.01 | 0.73±0.02 | mAb-7 | 1.06 | 1.01 | 1.07 | 1.06 | 1.08 | 1.08 | 1.1 | 1.07 | 1.12 | 1.11 |
| REGN14234 | 0.59±0.01 | 1.25±0.03 | mAb-6 | 1.02 | 0.93 | 0.97 | 1 | 1.03 | 0.97 | 1.14 | 1.19 | 1.13 | 1.09 |
| REGN14247 | 0.58±0.01 | 1.24±0.03 | mAb-8 | 1.01 | 0.94 | 0.96 | 0.98 | 1.02 | 0.97 | 1.13 | 1.15 | 1.11 | 1.06 |

FIG. 1 Continued

| REGN Nr/COMP mAb ID | REGN 14281 | REGN 13457 | REGN 13458 | REGN 13459 | REGN 14313 | REGN 14283 | REGN 10987 | REGN 14289 | REGN 14294 | REGN 14235 | REGN 14234 | REGN 14247 | REGN 14260 | REGN 14315 |
|---|---|---|---|---|---|---|---|---|---|---|---|---|---|---|
| REGN13457 | 0.06 | 0.05 | 0.05 | 0.06 | 0.1 | 0.06 | 0.06 | 0.06 | 0.07 | 0.06 | 0.07 | 0.13 | 0.05 | 0.08 |
| REGN13458 | 0.05 | 0.02 | 0.04 | 0.02 | 0.07 | 0.05 | 0.04 | 0.02 | 0.05 | 0.06 | 0.04 | 0.1 | 0.04 | 0.05 |
| REGN13459 | 0.03 | 0.02 | 0.03 | 0.02 | 0.08 | 0.03 | 0.02 | 0.03 | 0.04 | 0.06 | 0.04 | 0.1 | 0.02 | 0.06 |
| REGN14313 | 0.03 | 0 | 0.01 | 0.01 | 0.03 | 0.02 | 0.01 | 0 | 0.02 | 0.06 | 0.01 | 0.07 | 0.01 | 0.04 |
| REGN14283 | 0.03 | 0.04 | 0.04 | 0.03 | 0.09 | 0.04 | 0.04 | 0.04 | 0.04 | 0.07 | 0.05 | 0.13 | 0.02 | 0.05 |
| REGN10987 | 0.04 | 0.01 | 0.05 | 0.02 | 0.02 | 0.03 | 0.03 | 0.04 | 0.01 | 0.03 | 0.02 | 0.08 | 0.09 | 0.04 |
| REGN14289 | 0.37 | 0.04 | 0.05 | 0.05 | 0.08 | 0.05 | 0.1 | 0.04 | 0.04 | 0.06 | 0.06 | 0.11 | 0.08 | 1.05 |
| REGN14294 | 1.15 | 0.26 | 0.28 | 0.28 | 0.32 | 0.13 | 1.07 | 0.1 | 0.06 | 0.06 | 0.1 | 0.16 | 1.12 | 0.99 |
| REGN14235 | 1.16 | 0.29 | 0.32 | 0.34 | 0.42 | 0.31 | 0.35 | 0.33 | 0.28 | 0.18 | 0.33 | 0.4 | 0.35 | 0.3 |
| REGN14234 | 1.12 | 0.03 | 0.05 | 0.06 | 0.07 | 0.05 | 0.04 | 0.04 | 0.05 | 0.07 | 0.05 | 0.11 | 0.05 | 0.04 |
| REGN14247 | 1.09 | 0.03 | 0.05 | 0.05 | 0.09 | 0.05 | 0.03 | 0.04 | 0.04 | 0.06 | 0.05 | 0.11 | 0.06 | 0.04 |

FIG. 1 Continued

| REGN Nr/COMP mAb ID | REGN 14230 | REGN 14284 | REGN 10985 | | REGN 14252 | REGN 14292 | REGN 14314 |
|---|---|---|---|---|---|---|---|
| REGN13457 | 0.04 | 0.05 | 1.2 | 0.02 | 0.04 | 0.02 | -0.01 |
| REGN13458 | 0.03 | 0.02 | 1.16 | 0 | 0.04 | 0 | -0.01 |
| REGN13459 | 0.02 | 0.02 | 1.15 | 0.01 | 0.04 | 0 | -0.01 |
| REGN14313 | 0.04 | 0.03 | 1.19 | -0.02 | 0.04 | -0.02 | 0 |
| REGN14283 | 0.08 | 0.03 | 1.08 | -0.02 | 0.04 | 0 | 0.01 |
| REGN10987 | 0.06 | 0.02 | 1.12 | -0.05 | 0 | 0 | -0.03 |
| REGN14289 | 0.1 | 0.04 | 1.23 | -0.03 | 0.04 | 0 | 0.01 |
| REGN14294 | 0.09 | 0.08 | 1.29 | 0 | 0.04 | 0.76 | 0.02 |
| REGN14235 | 0.28 | 0.26 | 1.12 | 0 | 0.06 | 0.13 | 0.12 |
| REGN14234 | 0.04 | 0.03 | 1.08 | -0.01 | 0.07 | 0.06 | 0 |
| REGN14247 | 0.04 | 0.02 | 1.09 | 0 | 0.06 | 0.05 | -0.01 |

FIG. 1 Continued

| REGN Nr/COMP mAb ID | RBD.mmh monomer captured | mAb-1 bound (nm) | mAb-1 | REGN 14312 | REGN 14256 | REGN 14255 | REGN 10933 | REGN 14258 | REGN 14257 | REGN 14285 | REGN 14286 | REGN 14280 | REGN 14282 |
|---|---|---|---|---|---|---|---|---|---|---|---|---|---|
| REGN14260 | 0.58±0.01 | 1.15±0.03 | mab-13 | 1.02 | 0.98 | 1.01 | 1.05 | 1.06 | 1.03 | 1.01 | 0.44 | 1.11 | 0.74 |
| REGN14315 | 0.55±0.02 | 1.00±0.06 | mAb-27 | 0.98 | 0.16 | 0.18 | 0.89 | 0.98 | 1.14 | 0.92 | 0.9 | 0.77 | 1.04 |
| REGN14230 | 0.54±0.01 | 1.03±0.02 | mAb-4 | 1.06 | 0.03 | 0.06 | 0.99 | 1.01 | 0.99 | 0.99 | 0.99 | -0.01 | 1.09 |
| REGN14284 | 0.54±0.02 | 0.98±0.04 | mAb-18 | 0.96 | 0.07 | 0.11 | 0.94 | 0.81 | 0.51 | 0.97 | 0.79 | 0 | 1.01 |
| REGN10985 | 0.56±0.03 | 1.31±0.08 | mAb-32 | 1.03 | 0.2 | 1.41 | 0.91 | 0.92 | 0.79 | 0.87 | 0.95 | 1 | 1.01 |
| REGN1992 | 0.6±0.02 | -0.1±0.01 | mab-40 | 1.15 | 1.04 | 1.39 | 1.03 | 0.94 | 0.96 | 0.96 | 1.01 | 1.01 | 1.03 |
| REGN14232 | 0.61±0.02 | 0.03±0.01 | mab-5 | 1.02 | 1.06 | 1.35 | 1.08 | 1.03 | 1.02 | 1.03 | 1.01 | 1.11 | 1.06 |
| REGN14292 | 0.57±0.02 | 0.65±0.05 | mAb-22 | 0.62 | 0.62 | 0.96 | 0.54 | 0.64 | 0.49 | 0.48 | 0.55 | 0.61 | 0.55 |
| REGN14314 | 0.57±0.03 | 0.75±0.04 | mAb-26 | 0.77 | 0.5 | 0.51 | 0.59 | 0.46 | 0.8 | 0.62 | 0.45 | 0.15 | 0.81 |

FIG. 1 Continued

| REGN Nr/COMP mAb ID | REGN 14281 | REGN 13457 | REGN 13458 | REGN 13459 | REGN 14313 | REGN 14283 | REGN 10987 | REGN 14289 | REGN 14294 | REGN 14235 | REGN 14234 | REGN 14247 | REGN 14260 | REGN 14315 |
|---|---|---|---|---|---|---|---|---|---|---|---|---|---|---|
| REGN14260 | 1.1 | 0.02 | 0.05 | 0.05 | 0.09 | 0.05 | 0.05 | 0.04 | 0.05 | 0.06 | 0.06 | 0.1 | 0.05 | 0.05 |
| REGN14315 | 0.07 | 0.22 | 0.21 | 0.24 | 0.27 | 0.16 | 0.16 | 0.12 | 0.08 | 0.13 | 0.1 | 0.19 | 0.12 | 0.08 |
| REGN14230 | 0.06 | 0.04 | 0.05 | 0.05 | 0.1 | 0.06 | 0.06 | 0.05 | 0.04 | 0.04 | 0.05 | 0.12 | 0.05 | 0.05 |
| REGN14284 | 0.07 | 0.07 | 0.1 | 0.1 | 0.16 | 0.11 | 0.08 | 0.09 | 0.06 | 0.06 | 0.1 | 0.16 | 0.08 | 0.95 |
| REGN10985 | 1.02 | 0.82 | 0.88 | 0.88 | 1.13 | 0.82 | 0.99 | 0.93 | 0.96 | 0.67 | 1.02 | 1.12 | 1.09 | 0.99 |
| REGN1932 | 1.09 | 0.93 | 0.96 | 1.02 | 1.07 | 0.91 | 1 | 0.99 | 0.94 | 0.74 | 1.04 | 1.24 | 1.02 | 0.98 |
| REGN14232 | 1.16 | 0.9 | 0.98 | 1.02 | 0.99 | 0.88 | 0.99 | 0.97 | 0.92 | 0.7 | 1.06 | 1.07 | 1.04 | 0.95 |
| REGN14292 | 0.55 | 0.49 | 0.54 | 0.52 | 0.59 | 0.47 | 0.53 | 0.54 | 0.87 | 0.32 | 0.64 | 0.75 | 0.52 | 0.55 |
| REGN14314 | 0.47 | 0.44 | 0.47 | 0.43 | 0.57 | 0.45 | 0.51 | 0.47 | 0.46 | 0.29 | 0.54 | 0.62 | 0.45 | 0.49 |

FIG. 1 Continued

| REGN Nr/COMP mAb ID | REGN 14230 | REGN 14284 | REGN 10985 | | REGN 14232 | REGN 14292 | REGN 14314 |
|---|---|---|---|---|---|---|---|
| REGN14260 | 0.04 | 0.03 | 1.11 | | 0.04 | 0.01 | 0 |
| REGN14315 | 0.1 | 0.13 | 1.21 | 0 | 0.04 | 0.77 | 0.02 |
| REGN14230 | 0.05 | 0.04 | 1.13 | -0.01 | 0.03 | -0.01 | -0.01 |
| REGN14284 | 0.05 | 0.06 | 1.13 | -0.01 | 0.04 | 0 | 0.01 |
| REGN10985 | 0.98 | 0.74 | 0.05 | 0 | 0.12 | 0.71 | 0.8 |
| REGN1932 | 0.99 | 0.85 | 1.06 | -0.01 | 0.11 | 0.63 | 0.72 |
| REGN14232 | 1 | 0.86 | 1.11 | -0.02 | 0.11 | 0.61 | 0.65 |
| REGN14292 | 0.62 | 0.44 | 1.04 | -0.29 | -0.16 | 0.23 | 0.25 |
| REGN14314 | 0.54 | 0.44 | 0.91 | -0.36 | -0.24 | 0.17 | 0.22 |

FIG. 1 Continued

| # | mAb | nm RBD.mmh captured | nm mAb bound | mAb-1 | H4 mAb-38 | B38 mAb-37 | CA1 mAb-42 | 34 mAb-36 | 89 mAb-35 | Ly555 mAb-40 | REGN 15158 mAb-3 | REGN 15156 mAb-1 | REGN 15157 mAb-2 | REGN 15166 mAb-11 | REGN 15167 mAb-12 | Cb6 mAb-41 |
|---|---|---|---|---|---|---|---|---|---|---|---|---|---|---|---|---|
| 1 | H4 | 0.6±0.01 | 1.05±0.03 | mAb-38 | 100 | 102 | 83 | 81 | 104 | 77 | 86 | 82 | 80 | 83 | 82 | 83 |
| 2 | B38 | 0.61±0.02 | 1.03±0.03 | mAb-37 | 99 | 100 | 83 | 83 | 95 | 80 | 87 | 81 | 81 | 84 | 83 | 85 |
| 3 | CA1 | 0.57±0.01 | 1.18±0.03 | mAb-42 | 117 | 112 | 100 | 95 | 111 | 96 | 101 | 96 | 94 | 93 | 95 | 100 |
| 4 | REGN10934 | 0.57±0.01 | 1.2±0.03 | mAb-36 | 118 | 90 | 97 | 100 | 112 | 99 | 90 | 97 | 98 | 87 | 31 | 19 |
| 5 | REGN10989 | 0.58±0.02 | 0.87±0.02 | mAb-35 | 102 | 97 | 87 | 82 | 100 | 83 | 90 | 84 | 84 | 85 | 85 | 90 |
| 6 | Ly555 | 0.58±0.02 | 1.28±0.04 | mAb-40 | 116 | 107 | 103 | 96 | 113 | 100 | 101 | 98 | 95 | 96 | 97 | 102 |
| 7 | REGN15158 | 0.48±0.01 | 0.93±0.03 | mAb-3 | 114 | 109 | 99 | 93 | 112 | 98 | 100 | 95 | 94 | 95 | 95 | 101 |
| 8 | REGN15156 | 0.5±0.01 | 1.08±0.03 | mAb-1 | 118 | 112 | 105 | 100 | 115 | 102 | 104 | 100 | 99 | 101 | 100 | 105 |
| 9 | REGN15157 | 0.49±0.01 | 1.05±0.03 | mAb-2 | 119 | 113 | 106 | 103 | 116 | 102 | 104 | 100 | 100 | 102 | 102 | 108 |
| 10 | REGN15166 | 0.44±0.02 | 0.84±0.04 | mAb-11 | 120 | 114 | 105 | 90 | 117 | 103 | 104 | 99 | 98 | 100 | 100 | 106 |
| 11 | REGN15167 | 0.43±0.02 | 0.82±0.05 | mAb-12 | 119 | 113 | 104 | 38 | 116 | 102 | 104 | 94 | 88 | 100 | 100 | 104 |
| 12 | Cb6 | 0.58±0.01 | 1.19±0.03 | mAb-41 | 114 | 110 | 98 | 0 | 105 | 94 | 98 | 98 | 98 | 91 | 94 | 100 |
| 13 | REGN15150 | 0.47±0.02 | 0.93±0.05 | mAb-14 | 116 | 109 | 104 | 20 | 115 | 100 | 102 | 98 | 98 | 98 | 98 | 103 |
| 14 | REGN10954 | 0.45±0.02 | 0.83±0.06 | mAb-16 | 116 | 109 | 102 | 19 | 113 | 98 | 102 | 97 | 96 | 96 | 97 | 105 |
| 15 | REGN15162 | 0.49±0.01 | 0.97±0.03 | mAb-7 | 116 | 110 | 102 | 17 | 112 | 95 | 102 | 95 | 95 | 95 | 95 | 103 |

FIG. 2

| | REGN 15150 mAb-14 | REGN 10954 mAb-16 | REGN 15162 mAb-7 | REGN 15159 mAb-4 | REGN 15170 mAb-13 | REGN 15164 mAb-9 | REGN 15165 mAb-10 | REGN 15151 mAb-15 | REGN 15161 mAb-6 | REGN 15160 mAb-5 | 33 mAb-33 | REGN 15163 mAb-8 | REGN 14255 mAb-22 | REGN 14256 mAb-27 | REGN 14312 mAb-25 | REGN 10986 mAb-17 | REGN 10985 mAb-18 | CR 3022 mAb-43 | Lanza mAb-46 | REGN 14232 mAb-31 | 87 mAb-34 |
|---|---|---|---|---|---|---|---|---|---|---|---|---|---|---|---|---|---|---|---|---|---|
| 1 | 81 | 84 | 85 | 90 | 84 | 82 | 85 | 79 | 81 | 80 | 82 | 84 | 86 | 87 | 85 | 89 | 23 | 36 | 46 | 90 | 78 |
| 2 | 81 | 84 | 84 | 90 | 84 | 83 | 84 | 78 | 81 | 81 | 83 | 84 | 86 | 88 | 84 | 89 | 81 | 21 | 50 | 26 | 0 |
| 3 | 95 | 98 | 99 | 100 | 97 | 93 | 94 | 92 | 93 | 96 | 97 | 97 | 101 | 102 | 100 | 104 | 13 | 18 | 39 | 27 | 11 |
| 4 | 23 | 16 | 11 | 36 | 40 | 91 | 80 | 43 | 93 | 98 | 105 | 99 | 26 | 30 | 106 | 19 | 8 | 15 | 33 | 109 | 101 |
| 5 | 78 | 87 | 85 | 90 | 86 | 85 | 85 | 83 | 84 | 86 | 85 | 85 | 86 | 90 | 89 | 86 | 9 | 13 | 21 | 46 | 82 |
| 6 | 99 | 102 | 101 | 97 | 99 | 96 | 98 | 96 | 96 | 98 | 100 | 97 | 102 | 104 | 102 | 112 | 8 | 10 | 14 | 23 | 11 |
| 7 | 98 | 98 | 98 | 98 | 98 | 93 | 95 | 100 | 97 | 97 | 99 | 97 | 105 | 104 | 97 | 104 | 97 | 23 | 27 | 22 | 17 |
| 8 | 102 | 102 | 102 | 101 | 103 | 98 | 101 | 100 | 100 | 102 | 104 | 102 | 107 | 108 | 106 | 107 | 20 | 20 | 20 | 24 | 18 |
| 9 | 102 | 102 | 103 | 103 | 103 | 100 | 101 | 101 | 101 | 102 | 103 | 101 | 106 | 110 | 103 | 109 | 98 | 21 | 21 | 28 | 18 |
| 10 | 102 | 103 | 104 | 102 | 103 | 99 | 102 | 99 | 102 | 102 | 102 | 103 | 107 | 108 | 106 | 108 | 27 | 23 | 40 | 23 | 23 |
| 11 | 102 | 103 | 103 | 102 | 103 | 99 | 102 | 93 | 99 | 89 | 90 | 90 | 106 | 100 | 96 | 108 | 94 | 24 | 41 | 21 | 23 |
| 12 | 95 | 98 | 96 | 100 | 97 | 89 | 90 | 89 | 89 | 98 | 101 | 99 | 99 | 107 | 103 | 102 | 99 | 12 | 21 | 14 | 7 |
| 13 | 100 | 101 | 101 | 51 | 100 | 98 | 97 | 99 | 98 | 97 | 100 | 100 | 104 | 107 | 102 | 104 | 96 | 14 | 30 | 15 | 16 |
| 14 | 100 | 100 | 101 | 0 | 100 | 96 | 97 | 96 | 99 | 97 | 101 | 99 | 103 | 107 | 104 | 104 | 93 | 15 | 31 | 15 | 19 |
| 15 | 98 | 98 | 100 | 109 | 98 | 93 | 96 | 96 | 97 | 95 | 98 | 99 | 101 | 104 | 99 | 104 | 93 | 15 | 23 | 15 | 15 |

FIG. 2 Continued

|  | REGN 14289 mAb-24 | REGN 14283 mAb-28 | REGN 2130 mAb-44 | REGN 14247 mAb-30 | REGN 14234 mAb-23 | REGN 14230 mAb-19 | REGN 14315 mAb-26 | REGN 14284 mAb-20 | REGN 14235 mAb-21 | REGN 14294 mAb-29 | 7831 mAb-39 | used isotype control REGN 1932 mAb-32 | mAb-45 |
|---|---|---|---|---|---|---|---|---|---|---|---|---|---|
| 1 | 81 | 83 | 91 | 88 | 13 | 46 | 20 | 80 | 75 | 15 | 26 | 1400 | 1350 |
| 2 | 2 | 16 | 2 | 39 | 20 | 22 | 15 | 46 | 42 | 19 | 22 | 900 | 650 |
| 3 | 47 | 98 | 102 | 22 | 9 | 9 | 10 | 20 | 16 | 12 | 13 | 433 | 400 |
| 4 | 101 | 106 | 110 | 110 | 103 | 103 | 102 | 108 | 103 | 81 | 107 | 200 | 250 |
| 5 | 84 | 88 | 93 | 31 | 5 | 12 | 6 | 23 | 15 | 11 | 3 | 133 | 200 |
| 6 | 100 | 102 | 107 | 16 | 0 | 10 | 8 | 14 | 8 | 7 | 0 | 133 | 250 |
| 7 | 87 | 46 | 105 | 19 | 19 | 17 | 17 | 17 | 19 | 19 | 20 | 200 | 400 |
| 8 | 102 | 107 | 111 | 22 | 17 | 16 | 16 | 16 | 16 | 18 | 16 | 200 | 400 |
| 9 | 19 | 19 | 15 | 52 | 18 | 22 | 18 | 26 | 24 | 21 | 19 | 267 | 450 |
| 10 | 35 | 21 | 12 | 22 | 26 | 23 | 35 | 23 | 26 | 29 | 28 | 300 | 400 |
| 11 | 24 | 20 | 10 | 18 | 27 | 13 | 39 | 25 | 28 | 32 | 30 | 300 | 450 |
| 12 | 25 | 11 | 10 | 14 | 13 | 18 | 5 | 12 | 11 | 8 | 14 | 300 | 350 |
| 13 | 21 | 13 | 2 | 17 | 18 | 21 | 15 | 22 | 20 | 18 | 19 | 233 | 350 |
| 14 | 12 | 13 | 6 | 12 | 23 | 18 | 30 | 23 | 28 | 27 | 24 | 233 | 350 |
| 15 | 17 | 14 | 3 | 12 | 19 | 18 | 15 | 19 | 18 | 19 | 19 | 167 | 300 |

FIG. 2 Continued

| # | mAb | nm RBD.mmh captured | nm mAb bound | mAb-1 | H4 mAb-38 | B38 mAb-37 | CA1 mAb-42 | 34 mAb-36 | 89 mAb-35 | Ly555 mAb-40 | REGN 15158 mAb-3 | REGN 15156 mAb-1 | REGN 15157 mAb-2 | REGN 15166 mAb-11 | REGN 15167 mAb-12 | Cb6 mAb-41 |
|---|---|---|---|---|---|---|---|---|---|---|---|---|---|---|---|---|
| 16 | REGN15159 | 0.47±0.01 | 0.91±0.04 | mAb-1 | 116 | 112 | 101 | 17 | 113 | 98 | 102 | 95 | 95 | 95 | 96 | 102 |
| 17 | REGN15170 | 0.49±0.02 | 0.96±0.04 | mAb-4 | 116 | 109 | 103 | 23 | 113 | 99 | 102 | 97 | 98 | 98 | 97 | 103 |
| 18 | REGN15164 | 0.47±0.02 | 0.96±0.04 | mAb-13 | 118 | 112 | 105 | 52 | 116 | 102 | 104 | 100 | 98 | 100 | 100 | 105 |
| 19 | REGN15165 | 0.45±0.02 | 0.87±0.04 | mAb-9 | 117 | 111 | 104 | 42 | 115 | 103 | 104 | 99 | 98 | 98 | 99 | 106 |
| 20 | REGN15151 | 0.46±0.02 | 0.92±0.06 | mAb-10 | 117 | 111 | 105 | 35 | 115 | 104 | 101 | 99 | 99 | 99 | 99 | 104 |
| 21 | REGN15161 | 0.5±0.01 | 1.01±0.03 | mAb-15 | 117 | 111 | 103 | 69 | 113 | 102 | 103 | 97 | 98 | 98 | 100 | 104 |
| 22 | REGN15160 | 0.51±0.01 | 1.1±0.04 | mAb-6 | 118 | 111 | 105 | 83 | 116 | 103 | 104 | 99 | 99 | 100 | 100 | 104 |
| 23 | REGN10933 | 0.61±0.01 | 1.23±0.02 | mAb-5 | 115 | 110 | 102 | 97 | 112 | 98 | 101 | 97 | 96 | 96 | 96 | 103 |
| 24 | REGN15163 | 0.49±0.01 | 0.95±0.03 | mAb-33 | 117 | 110 | 102 | 92 | 115 | 101 | 103 | 98 | 97 | 97 | 97 | 103 |
| 25 | REGN14255 | 0.59±0.02 | 1.15±0.05 | mAb-8 | 111 | 104 | 98 | 2 | 110 | 98 | 98 | 92 | 95 | 96 | 98 | 101 |
| 26 | REGN14256 | 0.53±0.02 | 1.03±0.05 | mAb-22 | 110 | 105 | 100 | 30 | 102 | 94 | 96 | 99 | 87 | 89 | 93 | 102 |
| 27 | REGN14312 | 0.56±0.01 | 1.13±0.03 | mAb-27 | 111 | 105 | 100 | 93 | 105 | 98 | 102 | 88 | 91 | 96 | 96 | 99 |
| 28 | REGN10986 | 0.6±0.02 | 1.13±0.05 | mab-25 | 106 | 103 | 96 | -3 | 100 | 88 | 94 | 10 | 84 | 88 | 90 | 97 |
| 29 | REGN10985 | 0.58±0.01 | 1.24±0.04 | mab-17 | 0 | 24 | 12 | -1 | 6 | 11 | 21 | 20 | 16 | 14 | 17 | 24 |
| 32 | CR3022 | 0.56±0.01 | 1.3±0.05 | mAb-43 | 22 | 15 | 25 | 9 | 27 | 17 | 18 | 18 | 12 | 23 | 22 | 13 |
| 33 | Lanza | 0.57±0.01 | 0.68±0.03 | mAb-46 | 10 | 10 | 13 | 9 | 10 | 10 | 18 | 17 | 15 | 17 | 15 | 13 |

FIG. 2 Continued

| | REGN 15150 | REGN 10954 | REGN 15162 | REGN 15159 | REGN 15170 | REGN 15164 | REGN 15165 | REGN 15151 | REGN 15161 | REGN 15160 | 33 | REGN 15163 | REGN 14255 | REGN 14256 | REGN 14312 | REGN 10386 | REGN 10985 | CR 3022 | Lanza | REGN 14232 | 87 |
|---|---|---|---|---|---|---|---|---|---|---|---|---|---|---|---|---|---|---|---|---|---|
| | mAb-14 | mAb-16 | mAb-7 | mAb-4 | mAb-13 | mAb-9 | mAb-10 | mAb-15 | mAb-6 | mAb-5 | mAb-33 | mAb-8 | mAb-22 | mAb-27 | mAb-25 | mAb-17 | mAb-18 | mAb-43 | mAb-46 | mAb-31 | mAb-34 |
| 16 | 98 | 98 | 99 | 100 | 99 | 93 | 96 | 96 | 96 | 98 | 99 | 97 | 101 | 104 | 100 | 104 | 99 | 21 | 27 | 21 | 19 |
| 17 | 101 | 100 | 101 | 127 | 100 | 96 | 98 | 98 | 98 | 98 | 101 | 99 | 103 | 106 | 102 | 106 | 99 | 14 | 26 | 18 | 16 |
| 18 | 102 | 101 | 103 | 101 | 102 | 100 | 102 | 101 | 100 | 102 | 103 | 102 | 106 | 108 | 105 | 106 | 25 | 20 | 33 | 20 | 18 |
| 19 | 101 | 102 | 103 | 102 | 102 | 98 | 100 | 100 | 101 | 100 | 103 | 101 | 105 | 108 | 104 | 107 | 26 | 21 | 36 | 18 | 18 |
| 20 | 102 | 102 | 103 | 85 | 102 | 98 | 99 | 100 | 100 | 98 | 102 | 103 | 104 | 108 | 104 | 107 | 28 | 16 | 33 | 17 | 21 |
| 21 | 101 | 100 | 101 | 102 | 102 | 98 | 98 | 99 | 101 | 100 | 103 | 104 | 105 | 105 | 103 | 107 | 17 | 16 | 27 | 15 | 14 |
| 22 | 98 | 98 | 103 | 104 | 100 | 98 | 98 | 96 | 96 | 98 | 100 | 98 | 101 | 108 | 100 | 107 | 16 | 9 | 21 | 15 | 13 |
| 23 | 99 | 99 | 98 | 101 | 100 | 97 | 98 | 99 | 98 | 97 | 101 | 100 | 104 | 106 | 102 | 104 | 4 | 17 | 10 | 5 | -2 |
| 24 | 96 | 95 | 100 | 96 | 97 | 96 | 97 | 95 | 94 | 88 | 100 | 95 | 100 | 106 | 101 | 104 | 18 | 2 | 27 | 15 | 15 |
| 25 | 93 | 95 | 96 | 99 | 94 | 98 | 90 | 90 | 89 | 99 | 89 | 89 | 97 | 103 | 94 | 102 | 2 | 13 | 3 | 0 | 1 |
| 26 | 92 | 98 | 96 | 99 | 96 | 91 | 98 | 96 | 96 | 84 | 101 | 98 | 102 | 101 | 100 | 105 | 94 | 10 | 17 | 39 | 19 |
| 27 | 91 | 93 | 97 | 97 | 92 | 98 | 97 | 89 | 84 | 99 | 87 | 85 | 94 | 99 | 91 | 100 | 6 | 8 | 9 | 12 | 4 |
| 28 | 90 | 94 | 94 | 98 | 91 | 85 | 90 | 89 | 89 | 88 | 1 | 13 | 10 | 97 | 7 | 99 | 94 | 102 | 6 | 4 | -1 |
| 29 | 21 | 25 | 21 | 99 | 21 | 22 | 13 | 13 | 11 | 18 | 10 | 26 | 22 | 15 | 23 | 16 | 100 | 100 | 99 | 13 | 4 |
| 32 | 17 | 21 | 15 | 34 | 10 | 22 | 24 | 20 | 21 | 12 | 12 | 16 | 17 | 5 | 11 | 17 | 89 | 75 | 107 | 24 | 5 |
| 33 | | | | 27 | | 22 | 18 | 13 | 19 | | | | | | | | 71 | | 100 | 15 | 5 |

FIG. 2 Continued

| | REGN 14289 | REGN 14283 | REGN 2130 | REGN 14247 | REGN 14234 | REGN 14230 | REGN 14315 | REGN 14284 | REGN 14235 | REGN 14294 | 7831 | used isotype control REGN 1932 | |
|---|---|---|---|---|---|---|---|---|---|---|---|---|---|
| | mAb-24 | mAb-28 | mAb-44 | mAb-30 | mAb-23 | mAb-19 | mAb-26 | mAb-20 | mAb-21 | mAb-29 | mAb-39 | mAb-32 | mAb-45 |
| 16 | 23 | 21 | 12 | 22 | 19 | 18 | 19 | 21 | 21 | 23 | 20 | 167 | 300 |
| 17 | 13 | 12 | 3 | 18 | 19 | 20 | 7 | 22 | 22 | 18 | 15 | 200 | 300 |
| 18 | 22 | 19 | 10 | 17 | 20 | 20 | 18 | 20 | 20 | 15 | 19 | 200 | 300 |
| 19 | 22 | 18 | 10 | 16 | 21 | 21 | 22 | 21 | 22 | 20 | 20 | 233 | 350 |
| 20 | 16 | 14 | 7 | 14 | 23 | 22 | 25 | 24 | 25 | 26 | 27 | 233 | 350 |
| 21 | 17 | 11 | 3 | 10 | 18 | 18 | 15 | 17 | 18 | 16 | 17 | 200 | 350 |
| 22 | 17 | 14 | 8 | 14 | 16 | 19 | 14 | 18 | 18 | 15 | 18 | 167 | 300 |
| 23 | 0 | 0 | 0 | 2 | 0 | 2 | 0 | -1 | 0 | 0 | 1 | 167 | 250 |
| 24 | 18 | 12 | 7 | 12 | 17 | 18 | 16 | 19 | 19 | 18 | 17 | 200 | 150 |
| 25 | 0 | -1 | -16 | 0 | 2 | 6 | 2 | 3 | 3 | -2 | 3 | 67 | 100 |
| 26 | 18 | 18 | 17 | 45 | 15 | 16 | 23 | 41 | 41 | 20 | 17 | 133 | 0 |
| 27 | 14 | 20 | -70 | 12 | 6 | 7 | 6 | 10 | 9 | 7 | 7 | 33 | 0 |
| 28 | 0 | 0 | -7 | 3 | 0 | 0 | -1 | 0 | -1 | 3 | 3 | 33 | 50 |
| 29 | 5 | 7 | -1 | 9 | 4 | 4 | 6 | 5 | 4 | 5 | 11 | 100 | 200 |
| 32 | 10 | 15 | 16 | 20 | 13 | 11 | 15 | 17 | 14 | 19 | 22 | 133 | 300 |
| 33 | 9 | 9 | 1 | 10 | 14 | 6 | 9 | 17 | 14 | 17 | 0 | 267 | 250 |

FIG. 2 Continued

| | mAb | nm RBD.mmh captured | nm mAb bound | mAb-1 | H4 mAb-38 | B38 mAb-37 | CA1 mAb-42 | 34 mAb-36 | 89 mAb-35 | Ly555 mAb-40 | REGN15158 mAb-3 | REGN15156 mAb-1 | REGN15157 mAb-2 | REGN15166 mAb-11 | REGN15167 mAb-12 | Cb6 mAb-41 |
|---|---|---|---|---|---|---|---|---|---|---|---|---|---|---|---|---|
| 34 | REGN14232 | 0.55±0.02 | 0.93±0.06 | mab-31 | 84 | 19 | 12 | 85 | 30 | 16 | 13 | 21 | 17 | 17 | 12 | 22 |
| 35 | REGN10987 | 0.59±0.01 | 1.28±0.02 | mab-34 | 114 | -3 | 13 | 94 | 117 | 24 | 18 | 12 | 12 | 19 | 18 | 17 |
| 36 | REGN14289 | 0.57±0.02 | 1.17±0.06 | mab-24 | 108 | 0 | 25 | 94 | 105 | 91 | 96 | 97 | 19 | 11 | 10 | 15 |
| 37 | 2130 | 0.52±0.02 | 1.05±0.04 | mab-28 | 108 | 19 | 78 | 90 | 101 | 87 | 74 | 95 | 19 | 23 | 20 | 34 |
| 38 | REGN14283 | 0.55±0.02 | 1.03±0.04 | mab-44 | 107 | 13 | 74 | 82 | 101 | 86 | 90 | 91 | 16 | 21 | 17 | 26 |
| 39 | REGN14247 | 0.56±0.02 | 0.93±0.05 | mab-30 | 59 | 16 | 13 | 83 | 11 | 7 | 12 | 16 | 26 | 12 | 9 | 17 |
| 40 | REGN14234 | 0.58±0.02 | 1.25±0.05 | mab-23 | 1 | 18 | 12 | 98 | 13 | 7 | 17 | 19 | 16 | 15 | 15 | 15 |
| 41 | REGN14289 | 0.56±0.01 | 1.21±0.04 | mab-19 | 14 | 14 | 13 | 83 | 4 | 9 | 14 | 11 | 16 | 19 | 18 | 13 |
| 42 | REGN14230 | 0.54±0.02 | 1.03±0.05 | mab-26 | 11 | 15 | 21 | 85 | 7 | 8 | 15 | 9 | 19 | 23 | 20 | 21 |
| 43 | REGN14284 | 0.55±0.02 | 1.04±0.04 | mab-20 | 68 | 16 | 17 | 80 | 0 | 0 | 11 | 0 | 12 | 16 | 17 | 16 |
| 44 | REGN14315 | 0.61±0.02 | 1.2±0.05 | mab-21 | 56 | 5 | 0 | 89 | 6 | 5 | 0 | 14 | 0 | 0 | 0 | 0 |
| 45 | REGN14235 | 0.57±0.02 | 1.06±0.05 | mab-29 | 5 | 6 | 8 | 33 | 4 | 5 | 8 | 13 | 12 | 13 | 8 | 11 |
| 46 | REGN14294 | 0.59±0.02 | 1.09±0.03 | mab-39 | 1 | 12 | 14 | 48 | 0 | 5 | 10 | 0 | 9 | 14 | 13 | 13 |
| 31 | VIR7831 used isotype control REGN1932 | 0.54±0.02 | -0.1±0.01 | mab-32 | 31 | 29 | 31 | 26 | 17 | 21 | 22 | 27 | 26 | 25 | 21 | 31 |
| 30 | 2196 | 0.58±0.01 | 0.1±0.01 | mAb-45 | 25 | 22 | 22 | 20 | 13 | 22 | 23 | 26 | 26 | 29 | 27 | 26 |

FIG. 2 Continued

| | REGN 15150 mAb-14 | REGN 10954 mAb-16 | REGN 15162 mAb-7 | REGN 15159 mAb-4 | REGN 15170 mAb-13 | REGN 15164 mAb-9 | REGN 15165 mAb-10 | REGN 15151 mAb-15 | REGN 15161 mAb-6 | REGN 15160 mAb-5 | 33 mAb-33 | REGN 15163 mAb-8 | REGN 14255 mAb-22 | REGN 14256 mAb-27 | REGN 14312 mAb-25 | REGN 10986 mAb-17 | REGN 10985 mAb-18 | CR 3022 mAb-43 | Lanza mAb-46 | REGN 14232 mAb-31 | 87 mAb-34 |
|---|---|---|---|---|---|---|---|---|---|---|---|---|---|---|---|---|---|---|---|---|---|
| 34 | 17 | 12 | 11 | 34 | 19 | 23 | 22 | 15 | 20 | 21 | 16 | 15 | 18 | 44 | 22 | 19 | 11 | 11 | 30 | 100 | 89 |
| 35 | 16 | 21 | 16 | 30 | 11 | 17 | 17 | 19 | 16 | 14 | 6 | 21 | 13 | 29 | 13 | 10 | 10 | 10 | 9 | 109 | 100 |
| 36 | 14 | 10 | 10 | 27 | 7 | 15 | 16 | 13 | 15 | 16 | 7 | 12 | 11 | 1 | 19 | 10 | 8 | 5 | 4 | 105 | 99 |
| 37 | 25 | 17 | 16 | 33 | 15 | 27 | 26 | 21 | 22 | 21 | 8 | 19 | 17 | 15 | 52 | 12 | 16 | 13 | 23 | 105 | 98 |
| 38 | 20 | 17 | 14 | 29 | 14 | 22 | 23 | 19 | 18 | 20 | 12 | 17 | 14 | 15 | 64 | 11 | 10 | 14 | 27 | 101 | 90 |
| 39 | 13 | 9 | 9 | 27 | 8 | 17 | 17 | 11 | 16 | 15 | 11 | 11 | 14 | 10 | 16 | 12 | 8 | 6 | 16 | 101 | 89 |
| 40 | 17 | 17 | 17 | 33 | 16 | 17 | 18 | 16 | 19 | 18 | 12 | 16 | 16 | 6 | 16 | 16 | 8 | 7 | 17 | 99 | 93 |
| 41 | 20 | 17 | 16 | 30 | 15 | 14 | 19 | 19 | 17 | 17 | 2 | 15 | 14 | 10 | 15 | 6 | 13 | 13 | 14 | 104 | 96 |
| 42 | 20 | 20 | 14 | 30 | 11 | 21 | 20 | 19 | 23 | 19 | 6 | 18 | 18 | 13 | 26 | 10 | 13 | 13 | 19 | 101 | 91 |
| 43 | 20 | 17 | 15 | 30 | 15 | 15 | 21 | 18 | 14 | 14 | 0 | 13 | 10 | 13 | 16 | 5 | 9 | 10 | 14 | 103 | 93 |
| 44 | 0 | 0 | 0 | 18 | 0 | 0 | 0 | 0 | 0 | 0 | 0 | 0 | 0 | 0 | 0 | 0 | 0 | 0 | 0 | 103 | 96 |
| 45 | 10 | 6 | 7 | 26 | 4 | 12 | 12 | 10 | 14 | 13 | 9 | 9 | 14 | 0 | 11 | 8 | 5 | 2 | 11 | 97 | 87 |
| 46 | 12 | 15 | 11 | 29 | 10 | 14 | 18 | 12 | 14 | 12 | 4 | 14 | 11 | 4 | 15 | 8 | 3 | 4 | 10 | 95 | 84 |
| 31 | 20 | 17 | 18 | 36 | 16 | 33 | 31 | 21 | 31 | 27 | 24 | 21 | 30 | 12 | 31 | 23 | 19 | 14 | 33 | 15 | 22 |
| 30 | 22 | 26 | 19 | 36 | 22 | 30 | 26 | 25 | 28 | 25 | 20 | 25 | 27 | 18 | 27 | 20 | 17 | 14 | 36 | 13 | 13 |

FIG. 2 Continued

| | REGN 14289 | REGN 14283 | REGN 2130 | REGN 14247 | REGN 14234 | REGN 14220 | REGN 14315 | REGN 14284 | REGN 14235 | REGN 14294 | 7831 | used isotype control REGN 1932 | |
|---|---|---|---|---|---|---|---|---|---|---|---|---|---|
| | mAb-24 | mAb-28 | mAb-44 | mAb-30 | mAb-23 | mAb-19 | mAb-26 | mAb-20 | mAb-21 | mAb-29 | mAb-39 | mAb-32 | mAb-45 |
| 34 | 91 | 92 | 99 | 99 | 93 | 90 | 95 | 94 | 94 | 96 | 100 | 300 | 150 |
| 35 | 99 | 103 | 108 | 111 | 103 | 101 | 108 | 105 | 106 | 108 | 100 | 167 | 50 |
| 36 | 100 | 102 | 109 | 108 | 100 | 99 | 104 | 100 | 102 | 105 | 99 | 100 | 0 |
| 37 | 99 | 100 | 103 | 105 | 102 | 101 | 105 | 102 | 102 | 104 | 104 | 100 | 100 |
| 38 | 91 | 94 | 100 | 102 | 95 | 93 | 96 | 97 | 96 | 100 | 101 | 100 | 100 |
| 39 | 88 | 91 | 99 | 100 | 92 | 91 | 96 | 94 | 94 | 96 | 100 | 67 | 100 |
| 40 | 94 | 98 | 101 | 102 | 100 | 97 | 103 | 96 | 96 | 103 | 104 | 100 | 100 |
| 41 | 96 | 94 | 100 | 107 | 102 | 100 | 105 | 103 | 103 | 104 | 105 | 100 | 50 |
| 42 | 91 | 90 | 97 | 102 | 96 | 96 | 100 | 100 | 98 | 101 | 102 | 67 | 50 |
| 43 | 93 | 93 | 95 | 105 | 98 | 97 | 102 | 99 | 100 | 101 | 103 | 67 | 0 |
| 44 | 96 | 98 | 102 | 106 | 98 | 97 | 98 | 100 | 100 | 101 | 101 | 33 | 0 |
| 45 | 89 | 90 | 95 | 99 | 96 | 91 | 97 | 94 | 94 | 100 | 103 | 0 | 50 |
| 46 | 84 | 85 | 92 | 98 | 92 | 88 | 97 | 91 | 89 | 98 | 100 | 33 | 0 |
| 31 | 23 | 20 | 12 | 15 | 21 | 24 | 21 | 27 | 26 | 16 | 21 | 100 | 100 |
| 30 | 21 | 19 | 6 | 11 | 13 | 17 | 9 | 19 | 18 | 12 | 11 | 67 | 400 |

FIG. 2 Continued

ANTI-SARS-CoV-2-SPIKE GLYCOPROTEIN ANTIBODIES AND ANTIGEN-BINDING FRAGMENTS

CROSS-REFERENCE TO RELATED APPLICATIONS

This application claims the benefit under 35 USC § 119(e) of U.S. Provisional Application Nos. 63/221,846, filed Jul. 14, 2021; 63/245,020, filed Sep. 16, 2021; 63/286,514, filed Dec. 6, 2021; 63/289,126, filed Dec. 13, 2021; 63/289,419, filed Dec. 14, 2021; 63/291,328, filed Dec. 17, 2021; 63/301,002, filed Jan. 19, 2022; 63/306,909, filed Feb. 4, 2022; and 63/354,632 filed Jul. 22, 2022, each of which is incorporated herein by reference in its entirety for all purposes.

SEQUENCE LISTING

This application incorporates by reference a computer readable Sequence Listing in ST.26 XML format, titled 11007US01-Sequence, created on Jul. 12, 2022, and containing 1,488,419 bytes

FIELD OF THE INVENTION

The present invention relates to antibodies and antigen-binding fragments that bind specifically to coronavirus spike proteins and methods for treating or preventing coronavirus infections with said antibodies and fragments.

BACKGROUND OF THE INVENTION

Newly identified viruses, such as coronaviruses, can be difficult to treat because they are not sufficiently characterized. The emergence of these newly identified viruses highlights the need for the development of novel antiviral strategies. Severe acute respiratory syndrome coronavirus 2 (SARS-CoV-2) is a newly-emergent coronavirus which causes a severe acute respiratory disease, COVID-19. SARS-CoV-2 was first identified from an outbreak in Wuhan, China and as of Jul. 8, 2022, the World Health Organization has reported 551,296,228 confirmed cases, resulting in 6,345,595 deaths. Clinical features of COVID-19 include fever, dry cough, and fatigue, and the disease can cause respiratory failure resulting in death.

In view of the continuing threat to human health, and in particular the emergence of new variants of the SARS-CoV-2 virus, there is still an urgent need for preventive and therapeutic antiviral therapies for SARS-CoV-2 control. Because this virus uses its spike glycoprotein for interaction with the cellular receptor ACE2 and the serine protease TMPRSS2 for entry into a target cell, this spike protein represents an attractive target for antibody therapeutics. In particular, fully human antibodies that specifically bind to the SARS-CoV-2-Spike protein (SARS-CoV-2-S) with high affinity and that inhibit virus infectivity could be important in the prevention and treatment of COVID-19.

SUMMARY OF THE INVENTION

There is a need for neutralizing therapeutic anti-SARS-CoV-2-Spike protein (SARS-CoV-2-S) antibodies and their use for treating or preventing viral infection. The present disclosure addresses this need, in part, by providing human anti-SARS-CoV-2-S antibodies, such as those of Table 4, and combinations thereof including, for example, combinations with other therapeutics (e.g., anti-inflammatory agents, antimalarial agents, antiviral agents, or other antibodies or antigen-binding fragments), and methods of use thereof for treating viral infections.

The present disclosure provides neutralizing human antigen-binding proteins that specifically bind to SARS-CoV-2-S, for example, antibodies or antigen-binding fragments thereof.

In one aspect, the present disclosure provides an isolated recombinant antibody or antigen-binding fragment thereof that specifically binds to a coronavirus spike protein (CoV-S), wherein the antibody has one or more of the following characteristics: (a) binds to CoV-S with an $EC_{50}$ of less than about $10^{-8}$ M; (b) demonstrates an increase in survival in a coronavirus-infected animal after administration to said coronavirus-infected animal, as compared to a comparable coronavirus-infected animal without said administration; and/or (c) comprises three heavy chain complementarity determining regions (CDRs) (HCDR1, HCDR2, and HCDR3) contained within a heavy chain variable region (HCVR) comprising an amino acid sequence having at least about 90% sequence identity to an HCVR of Table 4; and three light chain CDRs (LCDR1, LCDR2, and LCDR3) contained within a light chain variable region (LCVR) comprising an amino acid sequence having at least about 90% sequence identity to an LCVR Table 4.

In some cases, the antibody or antigen-binding fragment comprises: (a) a heavy chain variable region (e.g., an immunoglobulin HCVR) comprising the HCDR1, HCDR2, and HCDR3 of an antibody of Table 4; and/or (b) a light chain variable region (e.g., an immunoglobulin LCVR) comprising the LCDR1, LCDR2, and LCDR3 of an antibody of Table 4.

In some cases, the antibody or antigen-binding fragment comprises: (a) a heavy chain immunoglobulin variable region comprising an amino acid sequence having at least 90% amino acid sequence identity to an HCVR sequence of Table 4; and/or (b) a light chain immunoglobulin variable region comprising an amino acid sequence having at least 90% amino acid sequence identity to an LCVR sequence of Table 4.

In some embodiments, the antibody or antigen-binding fragment comprises the HCDR1, HCDR2, HCDR3, LCDR1, LCDR2, and LCDR3 of a single antibody of Table 4. In some embodiments, the antibody or antigen-binding fragment comprises an immunoglobulin that comprises the HCVR and the LCVR of a single antibody of Table 4.

In some embodiments, the antibody or antigen-binding fragment comprises: (a) a heavy chain variable region (HCVR) comprising three complementarity determining regions (CDRs) contained within the amino acid sequence of SEQ ID NO: 212; (b) a HCVR comprising HCDR1, HCDR2 and HCDR3 comprising the amino acid sequences of SEQ ID NOs: 214, 216 and 218, respectively; (c) a HCVR comprising the amino acid sequence of SEQ ID NO: 212; (d) a light chain variable region (LCVR) comprising three CDRs contained within the amino acid sequence of SEQ ID NO: 220; (e) a LCVR comprising LCDR1, LCDR2 and LCDR3 comprising the amino acid sequences of SEQ ID NOs: 222, 126 and 224, respectively; (f) a LCVR comprising the amino acid sequence of SEQ ID NO: 220; (g) a heavy chain (HC) comprising the amino acid sequence of SEQ ID NO: 226; (h) a light chain (LC) comprising the amino acid sequence of SEQ ID NO: 228; (i) a HCVR/LCVR pair comprising the CDRs contained within the amino acid sequences of SEQ ID NOs: 212/222, respectively; (j) a HCVR comprising HCDR1, HCDR2 and HCDR3 comprising the amino acid sequences of SEQ ID NOs: 214, 216 and 218, respectively, and a LCVR comprising LCDR1, LCDR2 and LCDR3 comprising the amino acid sequences of SEQ ID NOs: 222, 126 and 224, respectively; (k) a HCVR comprising the amino acid sequence of SEQ ID NO: 212 and a LCVR comprising the amino acid sequence of SEQ ID NO: 220; or (l) a HC comprising the amino acid sequence of SEQ ID NO: 226 and a LC comprising the amino acid sequence of SEQ ID NO: 228.

In some embodiments, the antibody or antigen-binding fragment comprises: (a) a heavy chain variable region (HCVR) comprising three complementarity determining regions (CDRs) contained within the amino acid sequence of SEQ ID NO: 362; (b) a HCVR comprising HCDR1, HCDR2 and HCDR3 comprising the amino acid sequences of SEQ ID NOs: 364, 366 and 368, respectively; (c) a HCVR comprising the amino acid sequence of SEQ ID NO: 362; (d) a light chain variable region (LCVR) comprising three CDRs contained within the amino acid sequence of SEQ ID NO: 370; (e) a LCVR comprising LCDR1, LCDR2 and LCDR3 comprising the amino acid sequences of SEQ ID NOs: 372, 106 and 374, respectively; (f) a LCVR comprising the amino acid sequence of SEQ ID NO: 370; (g) a heavy chain (HC) comprising the amino acid sequence of SEQ ID NO: 376; (h) a HC comprising the amino acid sequence of SEQ ID NO: 1077; (i) a light chain (LC) comprising the amino acid sequence of SEQ ID NO: 378; (j) a HCVR/LCVR pair comprising the CDRs contained within the amino acid sequences of SEQ ID NOs: 362/370, respectively; (k) a HCVR comprising HCDR1, HCDR2 and HCDR3 comprising the amino acid sequences of SEQ ID NOs: 364, 366 and 368, respectively, and a LCVR comprising LCDR1, LCDR2 and LCDR3 comprising the amino acid sequences of SEQ ID NOs: 372, 106 and 374 respectively; (l) a HCVR comprising the amino acid sequence of SEQ ID NO: 362 and a LCVR comprising the amino acid sequence of SEQ ID NO: 370; (m) a HC comprising the amino acid sequence of SEQ ID NO: 376 and a LC comprising the amino acid sequence of SEQ ID NO: 378; or (n) a HC comprising the amino acid sequence of SEQ ID NO: 1077 and a LC comprising the amino acid sequence of SEQ ID NO: 378.

In some embodiments, the antibody or antigen-binding fragment comprises: (a) a heavy chain variable region (HCVR) comprising three complementarity determining regions (CDRs) contained within the amino acid sequence of SEQ ID NO: 493; (b) a HCVR comprising HCDR1, HCDR2 and HCDR3 comprising the amino acid sequences of SEQ ID NOs: 495, 497 and 499, respectively; (c) a HCVR comprising the amino acid sequence of SEQ ID NO: 493; (d) a light chain variable region (LCVR) comprising three CDRs contained within the amino acid sequence of SEQ ID NO: 501; (e) a LCVR comprising LCDR1, LCDR2 and LCDR3 comprising the amino acid sequences of SEQ ID NOs: 503, 505 and 507, respectively; (f) a LCVR comprising the amino acid sequence of SEQ ID NO: 501; (g) a heavy chain (HC) comprising the amino acid sequence of SEQ ID NO: 509; (h) a HC comprising the amino acid sequence of SEQ ID NO: 1075; (i) a light chain (LC) comprising the amino acid sequence of SEQ ID NO: 511; (j) a HCVR/LCVR pair comprising the CDRs contained within the amino acid sequences of SEQ ID NOs: 493/501, respectively; (k) a HCVR comprising HCDR1, HCDR2 and HCDR3 comprising the amino acid sequences of SEQ ID NOs: 495, 497 and 3499 respectively, and a LCVR comprising LCDR1, LCDR2 and LCDR3 comprising the amino acid sequences of SEQ ID NOs: 503, 505 and 507 respectively; (l) a HCVR comprising the amino acid sequence of SEQ ID NO: 493 and a LCVR comprising the amino acid sequence of SEQ ID NO: 501; (m) a HC comprising the amino acid sequence of SEQ ID NO: 509 and a LC comprising the amino acid sequence of SEQ ID NO: 511; or (n) a HC comprising the amino acid sequence of SEQ ID NO: 1075 and a LC comprising the amino acid sequence of SEQ ID NO: 511.

In some embodiments, the antibody or antigen-binding fragment comprises: (a) a heavy chain variable region (HCVR) comprising three complementarity determining regions (CDRs) contained within the amino acid sequence of SEQ ID NO: 887; (b) a HCVR comprising HCDR1, HCDR2 and HCDR3 comprising the amino acid sequences of SEQ ID NOs: 889, 891 and 893, respectively; (c) a HCVR comprising the amino acid sequence of SEQ ID NO: 887; (d) a light chain variable region (LCVR) comprising three CDRs contained within the amino acid sequence of SEQ ID NO: 895; (e) a LCVR comprising LCDR1, LCDR2 and LCDR3 comprising the amino acid sequences of SEQ ID NOs: 897, 164 and 899, respectively; (f) a LCVR comprising the amino acid sequence of SEQ ID NO: 895; (g) a heavy chain (HC) comprising the amino acid sequence of SEQ ID NO: 901; (h) a light chain (LC) comprising the amino acid sequence of SEQ ID NO: 903; (i) a HCVR/LCVR pair comprising the CDRs contained within the amino acid sequences of SEQ ID NOs: 887/895, respectively; (j) a HCVR comprising HCDR1, HCDR2 and HCDR3 comprising the amino acid sequences of SEQ ID NOs: 889, 891 and 893, respectively, and a LCVR comprising LCDR1, LCDR2 and LCDR3 comprising the amino acid sequences of SEQ ID NOs: 897, 164 and 899, respectively; (k) a HCVR comprising the amino acid sequence of SEQ ID NO: 887 and a LCVR comprising the amino acid sequence of SEQ ID NO: 895; or (l) a HC comprising the amino acid sequence of SEQ ID NO: 901 and a LC comprising the amino acid sequence of SEQ ID NO: 903.

In one aspect, the present disclosure provides an antigen-binding protein that competes with the antibody or antigen-binding fragment as discussed above or herein for binding to CoV-S.

In one aspect, the present disclosure provides an antigen-binding protein that binds to the same epitope as, or to an overlapping epitope on, CoV-S as the antibody or antigen-binding fragment discussed above or herein.

In some embodiments, the antibody or antigen-binding fragment discussed above or herein is multispecific.

In some embodiments, the antibody or antigen-binding fragment comprises one or more of the following properties: (a) inhibits growth of coronavirus; (b) binds to the surface of a coronavirus; (c) limits spread of coronavirus infection of cells in vitro; and (d) protects mice engineered to express the human ACE2 or TMPRSS2 protein from death and/or weight loss caused by coronavirus infection.

In any of the various embodiments discussed above or herein, said CoV-S may be SARS-CoV-2-S.

In one aspect, the present disclosure provides a complex comprising an antibody or antigen-binding fragment as discussed above or herein bound to a CoV-S polypeptide. In some cases, the CoV-S is SARS-CoV-2-S.

In one aspect, the present disclosure provides a method for making an antibody or antigen-binding fragment as discussed above or herein, comprising: (a) introducing into a host cell one or more polynucleotides (e.g., a polynucleotide or pair of polynucleotides, as discussed below) encoding said antibody or antigen-binding fragment; (b) culturing the host cell under conditions favorable to expression of the one or more polynucleotides; and (c) optionally, isolating the antibody or antigen-binding fragment from the host cell and/or a medium in which the host cell is grown. In some cases, the host cell is a Chinese hamster ovary cell.

In one aspect, the present disclosure provides an antibody or antigen-binding fragment which is a product of the method discussed above.

In one aspect, the present disclosure provides a polypeptide comprising: (a) HCDR1, HCDR2, and HCDR3 of an HCVR domain of an antibody or antigen-binding fragment that comprises an HCVR amino acid sequence set forth in Table 4; or (b) LCDR1, LCDR2, and LCDR3 of an LCVR domain of an immunoglobulin chain that comprises an LCVR amino acid sequence set forth in Table 4.

In various embodiments, the present disclosure provides a polynucleotide encoding the polypeptide discussed above, a vector comprising the polynucleotide, and/or a host cell comprising the antibody or antigen-binding fragment or polypeptide or polynucleotide or vector. In various embodiments, the present disclosure provides a polynucleotide that encodes a HCVR, a LCVR, or both a HCVR and a LCVR of an antibody or antigen-binding fragment thereof as discussed above or herein. The HCVR and/or LCVR may be defined by the CDRs contained within the HCVR sequence, the LCVR sequence, or both the HCVR sequence and the LCVR sequence, respectively, as set forth in Table 4. The HCVR and/or LCVR may also be defined by the heavy chain CDR sequences, the light chain CDR sequences, or both the heavy and light chain CDR sequences, respectively, as set forth in Table 4. The HCVR and/or LCVR may also be defined by the HCVR sequence, the LCVR sequence, or both the HCVR and LCVR sequences, respectively, as set forth in Table 4. In various embodiments, the present disclosure provides a polynucleotide that encodes a heavy chain, a light chain, or both a heavy chain and a light chain of an antibody as discussed above or herein. The heavy chain and/or light chain may be defined by the heavy and light chain sequences, respectively, as set forth in Table 4. In various embodiments, the polynucleotide comprises a nucleic acid sequence as set forth in Table 5. In various embodiments, the present disclosure provides a vector or vectors comprising the polynucleotides discussed above, and/or a host cell comprising the polynucleotides or vectors, or HCVR or LCVR, or an assembled antibody or antigen-binding fragment thereof as discussed above or herein. In various embodiments, the present disclosure provides a pair of polynucleotides, wherein (a) the first polynucleotide encodes: (i) a HCVR comprising the CDR sequences contained in a HCVR of an antibody of Table 4, (ii) a HCVR comprising the HCDR1, HCDR2 and HCDR3 sequences as set forth for an antibody in Table 4, (iii) a HCVR comprising the HCVR sequence of an antibody of Table 4, or (iv) a heavy chain (HC) comprising the HC sequence of an antibody of Table 4; and (b) the second polynucleotide encodes: (i) a LCVR comprising the CDR sequences contained in a LCVR of an antibody of Table 4, (ii) a LCVR comprising the LCDR1, LCDR2 and LCDR3 sequences as set forth for an antibody in Table 4, (iii) a LCVR comprising the LCVR sequence of an antibody of Table 4, or (iv) a light chain (LC) comprising the LC sequence of an antibody of Table 4. In various embodiments, the present disclosure provides a pair of vectors comprising, respectively, the first and second polynucleotides discussed above, and/or a host cell comprising the pair of vectors.

In some embodiments, the pair of polynucleotides encodes components of an antibody or antigen-binding fragment thereof, such as: (a) the first polynucleotide encodes a HCVR comprising the CDRs contained in a HCVR comprising the amino acid sequence of SEQ ID NO: 212, and the second polynucleotide encodes a LCVR comprising the CDRs contained in a LCVR comprising the amino acid sequence of SEQ ID NO: 220; (b) the first polynucleotide encodes a HCVR comprising the HCDR1, HCDR2 and HCDR2 amino acid sequences of SEQ ID NOs: 214, 216 and 218, respectively, and the second polynucleotide encodes a LCVR comprising the LCDR1, LCDR2 and LCDR3 amino acid sequences of SEQ ID NOs: 222, 126 and 224, respectively; (c) the first polynucleotide encodes a HCVR comprising the amino acid sequence of SEQ ID NO: 212, and the second polynucleotide encodes a LCVR comprising the amino acid sequence of SEQ ID NO: 220; or (d) the first polynucleotide encodes a HC comprising the amino acid sequence of SEQ ID NO: 226, and the second polynucleotide encodes a LC comprising the amino acid sequence of SEQ ID NO: 228.

In some embodiments, the pair of polynucleotides encodes components of an antibody or antigen-binding fragment thereof, such as: (a) the first polynucleotide encodes a HCVR comprising the CDRs contained in a HCVR comprising the amino acid sequence of SEQ ID NO: 362, and the second polynucleotide encodes a LCVR comprising the CDRs contained in a LCVR comprising the amino acid sequence of SEQ ID NO: 370; (b) the first polynucleotide encodes a HCVR comprising the HCDR1, HCDR2 and HCDR2 amino acid sequences of SEQ ID NOs: 364, 366 and 368, respectively, and the second polynucleotide encodes a LCVR comprising the LCDR1, LCDR2 and LCDR3 amino acid sequences of SEQ ID NOs: 372, 106 and 374, respectively; (c) the first polynucleotide encodes a HCVR comprising the amino acid sequence of SEQ ID NO: 362, and the second polynucleotide encodes a LCVR comprising the amino acid sequence of SEQ ID NO: 370; (d) the first polynucleotide encodes a HC comprising the amino acid sequence of SEQ ID NO: 376, and the second polynucleotide encodes a LC comprising the amino acid sequence of SEQ ID NO: 378; or (e) the first polynucleotide encodes a HC comprising the amino acid sequence of SEQ ID NO: 1077, and the second polynucleotide encodes a LC comprising the amino acid sequence of SEQ ID NO: 378.

In some embodiments, the pair of polynucleotides encodes components of an antibody or antigen-binding fragment thereof, such as: (a) the first polynucleotide encodes a HCVR comprising the CDRs contained in a HCVR comprising the amino acid sequence of SEQ ID NO: 493, and the second polynucleotide encodes a LCVR comprising the CDRs contained in a LCVR comprising the amino acid sequence of SEQ ID NO: 501; (b) the first polynucleotide encodes a HCVR comprising the HCDR1, HCDR2 and HCDR2 amino acid sequences of SEQ ID NOs: 495, 497 and 499, respectively, and the second polynucleotide encodes a LCVR comprising the LCDR1, LCDR2 and LCDR3 amino acid sequences of SEQ ID NOs: 503, 505 and 507, respectively; (c) the first polynucleotide encodes a HCVR comprising the amino acid sequence of SEQ ID NO: 493, and the second polynucleotide encodes a LCVR comprising the amino acid sequence of SEQ ID NO: 501; (d) the first polynucleotide encodes a HC comprising the amino acid sequence of SEQ ID NO: 509, and the second polynucleotide encodes a LC comprising the amino acid sequence of SEQ ID NO: 511; or (e) the first polynucleotide encodes a HC comprising the amino acid sequence of SEQ ID NO: 1075, and the second polynucleotide encodes a LC comprising the amino acid sequence of SEQ ID NO: 511.

In some embodiments, the pair of polynucleotides encodes components of an antibody or antigen-binding fragment thereof, such as: (a) the first polynucleotide encodes a HCVR comprising the CDRs contained in a HCVR comprising the amino acid sequence of SEQ ID NO: 887, and the second polynucleotide encodes a LCVR comprising the CDRs contained in a LCVR comprising the amino acid sequence of SEQ ID NO: 895; (b) the first polynucleotide encodes a HCVR comprising the HCDR1, HCDR2 and HCDR2 amino acid sequences of SEQ ID NOs: 889, 891 and 893, respectively, and the second polynucleotide encodes a LCVR comprising the LCDR1, LCDR2 and LCDR3 amino acid sequences of SEQ ID NOs: 897, 164 and 899, respectively; (c) the first polynucleotide encodes a HCVR comprising the amino acid sequence of SEQ ID NO: 887, and the second polynucleotide encodes a LCVR comprising the amino acid sequence of SEQ ID NO: 895; or (d) the first polynucleotide encodes a HC comprising the amino acid sequence of SEQ ID NO: 901, and the second polynucleotide encodes a LC comprising the amino acid sequence of SEQ ID NO: 903.

In one aspect, the present disclosure provides a composition or kit comprising the antibody or antigen-binding fragment discussed above or herein in association with a further therapeutic agent.

In one aspect, the present disclosure provides a pharmaceutical composition comprising the antigen-binding protein discussed above or herein and pharmaceutically acceptable carrier and, optionally, a further therapeutic agent. In some cases, the composition or kit is in association with a further therapeutic agent which is an anti-viral drug or a vaccine. In some embodiments, the further therapeutic agent is selected from the group consisting of: an anti-inflammatory agent, an antimalarial agent, an antibody or antigen-binding fragment thereof that specifically binds TMPRSS2, and an antibody or antigen-binding fragment thereof that specifically binds to CoV-S. In some embodiments, the antimalarial agent is chloroquine or hydroxychloroquine. In some embodiments, the anti-inflammatory agent is an antibody. In some cases, this antibody is sarilumab, tocilizumab, or gimsilumab. In some cases, the composition or kit comprises a second antibody or antigen-binding fragment comprising the HCDR1, HCDR2, HCDR3, LCDR1, LCDR2, and LCDR3 sequences of Table 4. In some cases, the antibody that binds to CoV-S is casirivimab or imdevimab, In one aspect, the present disclosure provides a vessel or injection device comprising the antigen-binding protein or composition discussed above or herein.

In one aspect, the present disclosure provides a method for treating or preventing infection with a coronavirus, in a subject in need thereof, via administration of a therapeutically effective amount of antigen-binding protein as discussed above or herein. In some cases, the coronavirus is selected from the group consisting of SARS-CoV-2, SARS-CoV, and MERS-CoV.

In some embodiments, the subject is administered one or more further therapeutic agents. In some cases, the one or more further therapeutic agents is an anti-viral drug or a vaccine. In some cases, the one or more further therapeutic agents is selected from the group consisting of: an anti-inflammatory agent, an antimalarial agent, an antibody or antigen-binding fragment thereof that specifically binds TMPRSS2, and an antibody or antigen-binding fragment thereof that specifically binds to CoV-S. In some embodiments, the antimalarial agent is chloroquine or hydroxychloroquine. In some embodiments, the anti-inflammatory agent is an antibody. In some cases, this antibody is sarilumab, tocilizumab, or gimsilumab. In some cases, the subject is administered a second antibody or antigen-binding fragment comprising HCDR1, HCDR2, HCDR3, LCDR1, LCDR2, and LCDR3 sequences of Table 4. In some cases, the subject is administered a second antibody or antigen-binding fragment comprising HCDR1, HCDR2, HCDR3, LCDR1, LCDR2, and LCDR3 sequences of an antibody described in U.S. Pat. No. 10,787,501, e.g., mAb10933, mAb10987, or mAb10985. In some cases, the antibody that binds to CoV-S is casirivimab or imdevimab, In one aspect, the present disclosure provides a method for administering an antibody or antigen-binding fragment as discussed above or herein into the body of a subject comprising injecting the antibody or antigen-binding fragment into the body of the subject. In some cases, the antibody or antigen-binding fragment is injected into the body of the subject subcutaneously, intravenously or intramuscularly.

In any of the various embodiments of the antibody or antigen-binding fragment, composition, kit, complex, polypeptide, polynucleotide, vector, cell, or methods discussed above or herein, the antibody or antigen-binding binding fragment may comprise a VH3-66 or Vk1-33 variable domain sequence.

In one aspect, the present disclosure provides an isolated antibody or antigen-binding fragment thereof that binds a SARS-CoV-2 spike protein comprising the amino acid sequence set forth in SEQ ID NO: 1008, wherein said isolated antibody or antigen-binding fragment comprises three heavy chain complementarity determining regions (CDRs) (HCDR1, HCDR2 and HCDR3) contained within a heavy chain variable region (HCVR) comprising the amino acid sequence set forth in SEQ ID NO: 887, and three light chain complementarity determining regions (CDRs) (LCDR1, LCDR2 and LCDR3) contained within a light chain variable region (LCVR) comprising the amino acid sequence set forth in SEQ ID NO: 895.

In some cases, the HCDR1 comprises the amino acid sequence set forth in SEQ ID NO: 889, HCDR2 comprises the amino acid sequence set forth in SEQ ID NO: 891, HCDR3 comprises the amino acid sequence set forth in SEQ ID NO: 893, LCDR1 comprises the amino acid sequence set forth in SEQ ID NO: 897, LCDR2 comprises the amino acid sequence set forth in SEQ ID NO: 164, and LCDR3 comprises the amino acid sequence set forth in SEQ ID NO: 899. In some cases, the isolated antibody or antigen-binding fragment thereof comprises an HCVR that comprises the amino acid sequence set forth in SEQ ID NO: 887. In some cases, the isolated antibody or antigen-binding fragment thereof comprises an LCVR that comprises the amino acid sequence set forth in SEQ ID NO: 895. In some cases, the isolated antibody or antigen-binding fragment thereof comprises an HCVR that comprises the amino acid sequence set forth in SEQ ID NO: 887 and an LCVR that comprises the amino acid sequence set forth in SEQ ID NO: 895.

In one aspect, the present disclosure provides an isolated antibody that binds a SARS-CoV-2 spike protein comprising the amino acid sequence set forth in SEQ ID NO: 1008, wherein said isolated antibody comprises an immunoglobulin constant region, three heavy chain complementarity determining regions (CDRs) (HCDR1, HCDR2 and HCDR3) contained within a heavy chain variable region (HCVR) comprising the amino acid sequence set forth in SEQ ID NO: 887, and three light chain complementarity determining regions (CDRs) (LCDR1, LCDR2 and LCDR3) contained within a light chain variable region (LCVR) comprising the amino acid sequence set forth in SEQ ID NO: 895.

In some cases, the HCDR1 comprises the amino acid sequence set forth in SEQ ID NO: 889, HCDR2 comprises the amino acid sequence set forth in SEQ ID NO: 891, HCDR3 comprises the amino acid sequence set forth in SEQ ID NO: 893, LCDR1 comprises the amino acid sequence set forth in SEQ ID NO: 897, LCDR2 comprises the amino acid sequence set forth in SEQ ID NO: 164, and LCDR3 comprises the amino acid sequence set forth in SEQ ID NO: 899. In some cases, the isolated antibody comprises an HCVR that comprises the amino acid sequence set forth in SEQ ID NO: 887 and an LCVR that comprises the amino acid sequence set forth in SEQ ID NO: 895. In some cases, the isolated antibody comprises a heavy chain comprising the amino acid sequence set forth in SEQ ID NO: 901 and a light chain comprising the amino acid sequence set forth in SEQ ID NO: 903. In some embodiments, the isolated antibody comprises an immunoglobulin constant region that is an IgG1 constant region. In some embodiments, the isolated antibody is a recombinant antibody. In some cases, the isolated antibody is multispecific.

In one aspect., the present disclosure provides a pharmaceutical composition comprising the isolated antibody discussed above and a pharmaceutically acceptable carrier or diluent. In some cases, the pharmaceutical composition further comprises a second therapeutic agent. In some cases, the second therapeutic agent is selected from the group consisting of: a second antibody, or an antigen-binding fragment thereof, that binds a SARS-CoV-2 spike protein comprising the amino acid sequence set forth in SEQ ID NO: 1008, an anti-inflammatory agent, an antimalarial agent, and an antibody or antigen-binding fragment thereof that binds TMPRSS2. In some cases, the second therapeutic agent is a second antibody, or an antigen-binding fragment thereof, that binds a SARS-CoV-2 spike protein comprising the amino acid sequence set forth in SEQ ID NO: 1008. In some embodiments, the second antibody or antigen-binding fragment thereof comprises three heavy chain CDRs (HCDR1, HCDR2 and HCDR3) contained within an HCVR comprising the amino acid sequence set forth in SEQ ID NO: 212, and three light chain CDRs (LCDR1, LCDR2 and LCDR3) contained within an LCVR comprising the amino acid sequence set forth in SEQ ID NO: 220. In some embodiments, the second antibody or antigen-binding fragment thereof comprises: HCDR1, comprising the amino acid sequence set forth in SEQ ID NO: 214; HCDR2, comprising the amino acid sequence set forth in SEQ ID NO: 216; HCDR3, comprising the amino acid sequence set forth in SEQ ID NO: 218; LCDR1, comprising the amino acid sequence set forth in SEQ ID NO: 222; LCDR2, comprising the amino acid sequence set forth in SEQ ID NO: 126; and LCDR3, comprising the amino acid sequence set forth in SEQ ID NO: 224. In some embodiments, the second antibody or antigen-binding fragment thereof comprises an HCVR comprising the amino acid sequence set forth in SEQ ID NO: 212 and an LCVR comprising the amino acid sequence set forth in SEQ ID NO: 220. In some embodiments, the second antibody or antigen-binding fragment thereof comprises a heavy chain comprising the amino acid sequence set forth in SEQ ID NO: 226 and a light chain comprising the amino acid sequence set forth in SEQ ID NO: 228.

In one aspect, the present disclosure provides an isolated antibody or antigen-binding fragment thereof that binds a SARS-CoV-2 spike protein comprising the amino acid sequence set forth in SEQ ID NO: 1008, wherein said isolated antibody or antigen-binding fragment comprises three heavy chain complementarity determining regions (CDRs) (HCDR1, HCDR2 and HCDR3) contained within a heavy chain variable region (HCVR) comprising the amino acid sequence set forth in SEQ ID NO: 212, and three light chain complementarity determining regions (CDRs) (LCDR1, LCDR2 and LCDR3) contained within a light chain variable region (LCVR) comprising the amino acid sequence set forth in SEQ ID NO: 220.

In some cases, the HCDR1 comprises the amino acid sequence set forth in SEQ ID NO: 214, HCDR2 comprises the amino acid sequence set forth in SEQ ID NO: 216, HCDR3 comprises the amino acid sequence set forth in SEQ ID NO: 218, LCDR1 comprises the amino acid sequence set forth in SEQ ID NO: 222, LCDR2 comprises the amino acid sequence set forth in SEQ ID NO: 126, and LCDR3 comprises the amino acid sequence set forth in SEQ ID NO: 224. In some cases, the isolated antibody or antigen-binding fragment thereof comprises an HCVR that comprises an amino acid sequence set forth in SEQ ID NO: 212. In some cases, the isolated antibody or antigen-binding fragment thereof comprises an LCVR that comprises an amino acid sequence set forth in SEQ ID NO: 220. In some cases, the isolated antibody or antigen-binding fragment thereof comprises an HCVR that comprises an amino acid sequence set forth in SEQ ID NO: 212 and an LCVR that comprises an amino acid sequence set forth in SEQ ID NO: 220.

In one aspect, the present disclosure provides an isolated antibody that binds a SARS-CoV-2 spike protein comprising the amino acid sequence set forth in SEQ ID NO: 1008, wherein said isolated antibody comprises an immunoglobulin constant region, three heavy chain complementarity determining regions (CDRs) (HCDR1, HCDR2 and HCDR3) contained within a heavy chain variable region (HCVR) comprising the amino acid sequence set forth in SEQ ID NO: 212, and three light chain complementarity determining regions (CDRs) (LCDR1, LCDR2 and LCDR3) contained within a light chain variable region (LCVR) comprising the amino acid sequence set forth in SEQ ID NO: 220.

In some cases, the HCDR1 comprises the amino acid sequence set forth in SEQ ID NO: 214, HCDR2 comprises the amino acid sequence set forth in SEQ ID NO: 216, HCDR3 comprises the amino acid sequence set forth in SEQ ID NO: 218, LCDR1 comprises the amino acid sequence set forth in SEQ ID NO: 222, LCDR2 comprises the amino acid sequence set forth in SEQ ID NO: 126, and LCDR3 comprises the amino acid sequence set forth in SEQ ID NO: 224. In some cases, the isolated antibody comprises an HCVR that comprises the amino acid sequence set forth in SEQ ID NO: 212 and an LCVR that comprises the amino acid sequence set forth in SEQ ID NO: 220. In some cases, the isolated antibody comprises a heavy chain comprising the amino acid sequence set forth in SEQ ID NO: 226 and a light chain comprising the amino acid sequence set forth in SEQ ID NO: 228. In some embodiments, the isolated antibody comprises an immunoglobulin constant region that is an IgG1 constant region. In some embodiments, the isolated antibody is a recombinant antibody. In some embodiments, the isolated antibody is multispecific.

In one aspect, the present disclosure provides a pharmaceutical composition comprising the isolated antibody discussed above and a pharmaceutically acceptable carrier or diluent. In some cases, the pharmaceutical composition further comprises a second therapeutic agent. In some cases, the second therapeutic agent is selected from the group consisting of: a second antibody, or an antigen-binding fragment thereof, that binds a SARS-CoV-2 spike protein comprising the amino acid sequence set forth in SEQ ID NO: 1008, an anti-inflammatory agent, an antimalarial agent, and an antibody or antigen-binding fragment thereof that binds TMPRSS2. In some cases, the second therapeutic agent is a second antibody, or an antigen-binding fragment thereof, that binds a SARS-CoV-2 spike protein comprising the amino acid sequence set forth in SEQ ID NO: 1008. In some cases, the second antibody or antigen-binding fragment thereof comprises three heavy chain CDRs (HCDR1, HCDR2 and HCDR3) contained within an HCVR comprising the amino acid sequence set forth in SEQ ID NO: 887, and three light chain CDRs (LCDR1, LCDR2 and LCDR3) contained within an LCVR comprising the amino acid sequence set forth in SEQ ID NO: 895. In some cases, the second antibody or antigen-binding fragment thereof comprises: HCDR1, comprising the amino acid sequence set forth in SEQ ID NO: 889; HCDR2, comprising the amino acid sequence set forth in SEQ ID NO: 891; HCDR3, comprising the amino acid sequence set forth in SEQ ID NO: 893; LCDR1, comprising the amino acid sequence set forth in SEQ ID NO: 897; LCDR2, comprising the amino acid sequence set forth in SEQ ID NO: 164; and LCDR3, comprising the amino acid sequence set forth in SEQ ID NO: 899. In some cases, the second antibody or antigen-binding fragment thereof comprises an HCVR comprising the amino acid sequence set forth in SEQ ID NO: 887 and an LCVR comprising the amino acid sequence set forth in SEQ ID NO: 895. In some cases, the second antibody or antigen-binding fragment thereof comprises a heavy chain comprising the amino acid sequence set forth in SEQ ID NO: 901 and a light chain comprising the amino acid sequence set forth in SEQ ID NO: 903.

In one aspect, the present disclosure provides an isolated antibody that binds a SARS-CoV-2 spike protein comprising the amino acid sequence set forth in SEQ ID NO: 1008, wherein said isolated antibody comprises an immunoglobulin constant region, three heavy chain complementarity determining regions (CDRs) (HCDR1, HCDR2 and HCDR3) contained within a heavy chain variable region (HCVR) comprising the amino acid sequence set forth in SEQ ID NO: 270, and three light chain complementarity determining regions (CDRs) (LCDR1, LCDR2 and LCDR3) contained within a light chain variable region (LCVR) comprising the amino acid sequence set forth in SEQ ID NO: 278.

In some embodiments, HCDR1 comprises the amino acid sequence set forth in SEQ ID NO: 272, HCDR2 comprises the amino acid sequence set forth in SEQ ID NO: 274, HCDR3 comprises the amino acid sequence set forth in SEQ ID NO: 276, LCDR1 comprises the amino acid sequence set forth in SEQ ID NO: 280, LCDR2 comprises the amino acid sequence set forth in SEQ ID NO: 106, and LCDR3 comprises the amino acid sequence set forth in SEQ ID NO: 282. In some cases, the antibody comprises an HCVR that comprises the amino acid sequence set forth in SEQ ID NO: 270 and an LCVR that comprises the amino acid sequence set forth in SEQ ID NO: 278. In some cases, the antibody comprises a heavy chain comprising the amino acid sequence set forth in SEQ ID NO: 284 and a light chain comprising the amino acid sequence set forth in SEQ ID NO: 286. In some embodiments, the immunoglobulin constant region is an IgG1 constant region. In some cases, the antibody is a recombinant antibody. In some cases, the antibody is multispecific.

In one aspect, the present disclosure provides, the present disclosure provides a pharmaceutical composition comprising the isolated antibody discussed above and a pharmaceutically acceptable carrier or diluent.

In some cases, the pharmaceutical composition further comprises a second therapeutic agent. In some cases, the second therapeutic agent is selected from the group consisting of: a second antibody, or an antigen-binding fragment thereof, that binds a SARS-CoV-2 spike protein comprising the amino acid sequence set forth in SEQ ID NO: 1008, an anti-inflammatory agent, an antimalarial agent, and an antibody or antigen-binding fragment thereof that binds TMPRSS2.

In some embodiments, the second therapeutic agent is a second antibody, or an antigen-binding fragment thereof, that binds a SARS-CoV-2 spike protein comprising the amino acid sequence set forth in SEQ ID NO: 1008. In some cases, the second antibody or antigen-binding fragment thereof comprises three heavy chain CDRs (HCDR1, HCDR2 and HCDR3) contained within an HCVR comprising the amino acid sequence set forth in SEQ ID NO: 212, and three light chain CDRs (LCDR1, LCDR2 and LCDR3) contained within an LCVR comprising the amino acid sequence set forth in SEQ ID NO: 220. In some cases, the second antibody or antigen-binding fragment thereof comprises: HCDR1, comprising the amino acid sequence set forth in SEQ ID NO: 214; HCDR2, comprising the amino acid sequence set forth in SEQ ID NO: 216; HCDR3, comprising the amino acid sequence set forth in SEQ ID NO: 218; LCDR1, comprising the amino acid sequence set forth in SEQ ID NO: 222; LCDR2, comprising the amino acid sequence set forth in SEQ ID NO: 126; and LCDR3, comprising the amino acid sequence set forth in SEQ ID NO: 224. In some cases, the second antibody or antigen-binding fragment thereof comprises an HCVR comprising the amino acid sequence set forth in SEQ ID NO: 212 and an LCVR comprising the amino acid sequence set forth in SEQ ID NO: 220. In some cases, the second antibody or antigen-binding fragment thereof comprises a heavy chain comprising the amino acid sequence set forth in SEQ ID NO: 226 and a light chain comprising the amino acid sequence set forth in SEQ ID NO: 228.

In one aspect, the present disclosure provides a pharmaceutical composition comprising: a) a first isolated antibody that binds a SARS-CoV-2 spike protein comprising the amino acid sequence set forth in SEQ ID NO: 1008, wherein said first isolated antibody comprises an immunoglobulin constant region, three heavy chain complementarity determining regions (CDRs) (HCDR1, HCDR2 and HCDR3) contained within a heavy chain variable region (HCVR) comprising the amino acid sequence set forth in SEQ ID NO: 887, and three light chain complementarity determining regions (CDRs) (LCDR1, LCDR2 and LCDR3) contained within a light chain variable region (LCVR) comprising the amino acid sequence set forth in SEQ ID NO: 895; and b) a second isolated antibody that binds a SARS-CoV-2 spike protein comprising the amino acid sequence set forth in SEQ ID NO: 1008, wherein said second isolated antibody comprises an immunoglobulin constant region, three heavy chain complementarity determining regions (CDRs) (HCDR1, HCDR2 and HCDR3) contained within a heavy chain variable region (HCVR) comprising the amino acid sequence set forth in SEQ ID NO: 1030, and three light chain complementarity determining regions (CDRs) (LCDR1, LCDR2 and LCDR3) contained within a light chain variable region (LCVR) comprising the amino acid sequence set forth in SEQ ID NO: 1038.

In some embodiments, the first isolated antibody comprises: HCDR1 comprising the amino acid sequence set forth in SEQ ID NO: 889, HCDR2 comprising the amino acid sequence set forth in SEQ ID NO: 891, HCDR3 comprising the amino acid sequence set forth in SEQ ID NO: 893, LCDR1 comprising the amino acid sequence set forth in SEQ ID NO: 897, LCDR2 comprising the amino acid sequence set forth in SEQ ID NO: 164, and LCDR3 comprising the amino acid sequence set forth in SEQ ID NO: 899. In some cases, the first isolated antibody comprises: an HCVR that comprises the amino acid sequence set forth in SEQ ID NO: 887 and an LCVR that comprises the amino acid sequence set forth in SEQ ID NO: 895. In some cases, the first isolated antibody comprises: a heavy chain comprising the amino acid sequence set forth in SEQ ID NO: 901 and a light chain comprising the amino acid sequence set forth in SEQ ID NO: 903. In some embodiments, the first isolated antibody comprises: an immunoglobulin constant region that is an IgG1 constant region. In some cases, the first isolated antibody is a recombinant antibody. In some cases, the first isolated antibody is multispecific.

In some embodiments, the pharmaceutical composition further comprises a pharmaceutically acceptable carrier or diluent.

In some embodiments, the second isolated antibody comprises: HCDR1 comprising the amino acid sequence set forth in SEQ ID NO: 1032, HCDR2 comprising the amino acid sequence set forth in SEQ ID NO: 1034, HCDR3 comprising the amino acid sequence set forth in SEQ ID NO: 1036, LCDR1 comprising the amino acid sequence set forth in SEQ ID NO: 1040, LCDR2 comprising the amino acid sequence set forth in SEQ ID NO: 1042, and LCDR3 comprising the amino acid sequence set forth in SEQ ID NO: 1044. In some cases, the second isolated antibody comprises: an HCVR that comprises the amino acid sequence set forth in SEQ ID NO: 1030 and an LCVR that comprises the amino acid sequence set forth in SEQ ID NO: 1038. In some cases, the second isolated antibody comprises: a heavy chain comprising the amino acid sequence set forth in SEQ ID NO: 1048 and a light chain comprising the amino acid sequence set forth in SEQ ID NO: 1048.

In some embodiments, the pharmaceutical composition further comprises a third isolated antibody.

In some embodiments, the third isolated antibody binds a SARS-CoV-2 spike protein comprising the amino acid sequence set forth in SEQ ID NO: 1008, wherein said third isolated antibody comprises an immunoglobulin constant region, three heavy chain complementarity determining regions (CDRs) (HCDR1, HCDR2 and HCDR3) contained within a heavy chain variable region (HCVR) comprising the amino acid sequence set forth in SEQ ID NO: 1010, and three light chain complementarity determining regions (CDRs) (LCDR1, LCDR2 and LCDR3) contained within a light chain variable region (LCVR) comprising the amino acid sequence set forth in SEQ ID NO: 1018. In some cases, the third isolated antibody comprises: HCDR1 comprising the amino acid sequence set forth in SEQ ID NO: 1012, HCDR2 comprising the amino acid sequence set forth in SEQ ID NO: 1014, HCDR3 comprising the amino acid sequence set forth in SEQ ID NO: 1016, LCDR1 comprising the amino acid sequence set forth in SEQ ID NO: 1020, LCDR2 comprising the amino acid sequence set forth in SEQ ID NO: 1022, and LCDR3 comprising the amino acid sequence set forth in SEQ ID NO: 1024. In some cases, the third isolated antibody comprises: an HCVR that comprises the amino acid sequence set forth in SEQ ID NO: 1010 and an LCVR that comprises the amino acid sequence set forth in SEQ ID NO: 1018. In some cases, the third isolated antibody comprises: a heavy chain comprising the amino acid sequence set forth in SEQ ID NO: 1026 and a light chain comprising the amino acid sequence set forth in SEQ ID NO: 1028.

In one aspect, the present disclosure provides a method for treating or preventing infection with an Omicron variant SARS-CoV-2, in a subject in need thereof, comprising administering a therapeutically effective amount of an antibody or antigen binding fragment thereof comprising three heavy chain complementarity determining regions (CDRs) (HCDR1, HCDR2, and HCDR3) contained within a heavy chain variable region (HCVR) comprising an amino acid sequence having at least about 90% sequence identity to an HCVR of Table 4; and three light chain CDRs (LCDR1, LCDR2, and LCDR3) contained within a light chain variable region (LCVR) comprising an amino acid sequence having at least about 90% sequence identity to an LCVR Table 4.

In one aspect, the present disclosure provides a method for preventing one or more COVID-19 symptoms resulting from infection with an Omicron variant SARS-CoV-2, in a subject in need thereof, comprising administering a therapeutically effective amount of an antibody or antigen binding fragment thereof comprising three heavy chain complementarity determining regions (CDRs) (HCDR1, HCDR2, and HCDR3) contained within a heavy chain variable region (HCVR) comprising an amino acid sequence having at least about 90% sequence identity to an HCVR of Table 4; and three light chain CDRs (LCDR1, LCDR2, and LCDR3) contained within a light chain variable region (LCVR) comprising an amino acid sequence having at least about 90% sequence identity to an LCVR Table 4.

In some embodiments of the methods, preventing comprises pre-exposure prophylaxis. In some embodiments of the methods, preventing comprises post-exposure prophylaxis.

In some cases, the antibody or antigen-binding fragment comprises: (a) an immunoglobulin heavy chain variable region comprising the HCDR1, HCDR2, and HCDR3 of an antibody of Table 4; and/or (b) an immunoglobulin light chain variable region comprising the LCDR1, LCDR2, and LCDR3 of an antibody of Table 4.

In some cases, the antibody or antigen-binding fragment comprises the HCDR1, HCDR2, and HCDR3 of an antibody of Table 4 and the LCDR1, LCDR2, and LCDR3 of said antibody of Table 4.

In some embodiments of the methods, the subject is administered one or more further therapeutic agents. In some cases, the one or more further therapeutic agents is an anti-viral drug or a vaccine. In some cases, the one or more further therapeutic agents is selected from the group consisting of: an anti-inflammatory agent, an antimalarial agent, an antibody or antigen-binding fragment thereof that specifically binds TMPRSS2, and an antibody or antigen-binding fragment thereof that specifically binds to CoV-S. In some embodiments, the anti-inflammatory agent is an antibody, such as sarilumab, tocilizumab, or gimsilumab. In some cases, the antibody that binds to CoV-S is casirivimab or imdevimab, in some embodiments of the methods, the antibody or antigen-binding fragment comprises the HCDR1, HCDR2, HCDR3, LCDR1, LCDR2, and LCDR3 sequences of a second antibody of Table 4.

In some embodiments of the methods, administering comprises injecting the antibody or antigen-binding fragment into the body of the subject. In some cases, the antibody or antigen-binding fragment is injected into the body of the subject subcutaneously, intravenously or intramuscularly.

In one aspect, the present disclosure provides a method for treating or preventing one or more COVID-19 symptoms resulting from infection with SARS-CoV-2, in a subject in need thereof, comprising administering a therapeutically effective amount of an antibody or antigen binding fragment thereof comprising three heavy chain complementarity determining regions (CDRs) (HCDR1, HCDR2, and HCDR3) contained within a heavy chain variable region (HCVR) comprising the amino acid sequence set forth in SEQ ID NO: 362; and three light chain CDRs (LCDR1, LCDR2, and LCDR3) contained within a light chain variable region (LCVR) comprising the amino acid sequence set forth in SEQ ID NO: 370.

In some embodiments, HCDR1 comprises the amino acid sequence set forth in SEQ ID NO: 364, HCDR2 comprises the amino acid sequence set forth in SEQ ID NO: 366, HCDR3 comprises the amino acid sequence set forth in SEQ ID NO: 368, LCDR1 comprises the amino acid sequence set forth in SEQ ID NO: 372, LCDR2 comprises the amino acid sequence set forth in SEQ ID NO: 106, and LCDR3 comprises the amino acid sequence set forth in SEQ ID NO: 374. In some cases, the antibody or antigen-binding fragment comprises an HCVR comprising the amino acid sequence set forth in SEQ ID NO: 362. In some cases, the antibody or antigen-binding fragment comprises an LCVR comprising the amino acid sequence set forth in SEQ ID NO: 370. In some cases, the antibody or antigen-binding fragment thereof comprises a heavy chain comprising the amino acid sequence set forth in SEQ ID NO: 376. In some cases, the antibody or antigen-binding fragment thereof comprises a light chain comprising the amino acid sequence set forth in SEQ ID NO: 378.

In some embodiments, administering comprises administering the antibody or antigen-binding fragment via injection. In some cases, injection is intravenous. In some cases, injection is subcutaneous.

In some embodiments, administering comprises administering 300 mg of said antibody or antigen-binding fragment thereof. In some embodiments, administering comprises administering 600 mg of said antibody or antigen-binding fragment thereof. In some embodiments, administering comprises administering 1200 mg of said antibody or antigen-binding fragment thereof.

In some embodiments, administering comprises administering two doses of said antibody or antigen-binding fragment thereof. In some cases, each of the two doses comprises 300 mg of the antibody or antigen-binding fragment thereof. In some cases, the two doses are administered 4 weeks apart, 5 weeks apart, 6 weeks apart, 7 weeks apart, 8 weeks apart, 9 weeks apart, 10 weeks apart, 11 weeks apart, 12 weeks apart, 13 weeks apart, 14 weeks apart, 15 weeks apart, or 16 weeks apart. In some cases, the two doses are administered 8-16 weeks apart. In some cases, the two doses are administered 12 weeks apart. In some cases, the two doses are administered 8 weeks apart.

In some embodiments, administering reduces the viral load of SARS-CoV-2 in said subject.

In some embodiments, administration of the antibody or antigen-binding fragment thereof occurs prior to SARS-CoV-2 infection.

In one aspect, the present disclosure provides a method for treating or preventing one or more COVID-19 symptoms resulting from infection with SARS-CoV-2, in a subject in need thereof, comprising administering a therapeutically effective amount of an antibody or antigen binding fragment thereof comprising three heavy chain complementarity determining regions (CDRs) (HCDR1, HCDR2, and HCDR3) contained within a heavy chain variable region (HCVR) comprising the amino acid sequence set forth in SEQ ID NO: 362; and three light chain CDRs (LCDR1, LCDR2, and LCDR3) contained within a light chain variable region (LCVR) comprising the amino acid sequence set forth in SEQ ID NO: 370, wherein said administering comprises administering to said subject two doses of said antibody or antigen-binding fragment thereof, each does comprising 300 mg of said antibody or antigen-binding fragment thereof.

In some embodiments, administering is subcutaneous.

In some embodiments, HCDR1 comprises the amino acid sequence set forth in SEQ ID NO: 364, HCDR2 comprises the amino acid sequence set forth in SEQ ID NO: 366, HCDR3 comprises the amino acid sequence set forth in SEQ ID NO: 368, LCDR1 comprises the amino acid sequence set forth in SEQ ID NO: 372, LCDR2 comprises the amino acid sequence set forth in SEQ ID NO: 106, and LCDR3 comprises the amino acid sequence set forth in SEQ ID NO: 374. In some cases, the antibody or antigen-binding fragment comprises an HCVR comprising the amino acid sequence set forth in SEQ ID NO: 362. In some cases, the antibody or antigen-binding fragment comprises an LCVR comprising the amino acid sequence set forth in SEQ ID NO: 370. In some cases, the antibody or antigen-binding fragment thereof comprises a heavy chain comprising the amino acid sequence set forth in SEQ ID NO: 376. In some cases, the antibody or antigen-binding fragment thereof comprises a light chain comprising the amino acid sequence set forth in SEQ ID NO: 378.

In one aspect, the present disclosure provides a polynucleotide encoding an antibody or antigen-binding fragment thereof; or a HCVR and/or a LCVR; or a heavy chain and/or a light chain of an antibody or antigen-binding fragment thereof, as discussed above or herein. The present disclosure further provides a vector or vectors comprising the polynucleotide discussed above or herein, and a host cell comprising the antibody or antigen-binding fragment, the polynucleotide or polynucleotides, and/or the vector or vectors discussed above or herein.

In some embodiments, administering comprises administering 600 mg of the antibody or antigen-binding fragment thereof. In some embodiments, administering comprises administering 300 mg of the antibody or antigen-binding fragment thereof.

In any of the various embodiments of the antibodies or antigen-binding fragments thereof discussed above or herein, the antibody or antigen-binding fragment may neutralize an omicron variant of SARS-CoV-2. In various embodiments, the omicron variant is selected from BA.1, BA.1.1, BA.2, BA.2.12.1, BA.3, or BA.4/ BA.5.

In various embodiments, any of the features or components of embodiments discussed above or herein may be combined, and such combinations are encompassed within the scope of the present disclosure. Any specific value discussed above or herein may be combined with another related value discussed above or herein to recite a range with the values representing the upper and lower ends of the range, and such ranges are encompassed within the scope of the present disclosure.

BRIEF DESCRIPTION OF THE FIGURES

FIG. 1 shows cross-competition between 41 anti-SARS-CoV-2-S monoclonal antibodies upon binding to immobilized SARS-Cov-2 RBD-MMH (SEQ ID NO: 1069). Red: Pre-bound mAb-1 reduced binding of mAb-2 to SARS-CoV-2 RBD-MMH by greater than 50%, and binding to SARS-CoV-2 RBD-MMH was also reduced by greater than 50% when the binding order of mAb-1 and mAb-2 was reversed. Yellow: Pre-bound mAb-1 reduced binding of mAb-2 to SARS-CoV-2 RBD-MMH by greater than 50%, but binding to SARS-CoV-2 RBD-MMH was reduced by less than 50% when the binding order of mAb-1 and mAb-2 was reversed.

FIG. 2 shows cross-competition between 15 anti-SARS-CoV-2-S monoclonal antibodies upon binding to immobilized SARS-Cov-2 RBD-MMH. Red: Pre-bound mAb-1 reduced binding of mAb-2 to SARS-CoV-2 RBD-MMH by greater than 50%, and binding to SARS-CoV-2 RBD-MMH was also reduced by greater than 50% when the binding order of mAb-1 and mAb-2 was reversed. Yellow: Pre-bound mAb-1 reduced binding of mAb-2 to SARS-CoV-2 RBD-MMH by greater than 50%, but binding to SARS-CoV-2 RBD-MMH was reduced by less than 50% when the binding order of mAb-1 and mAb-2 was reversed.

DETAILED DESCRIPTION OF THE INVENTION

Figure 3:
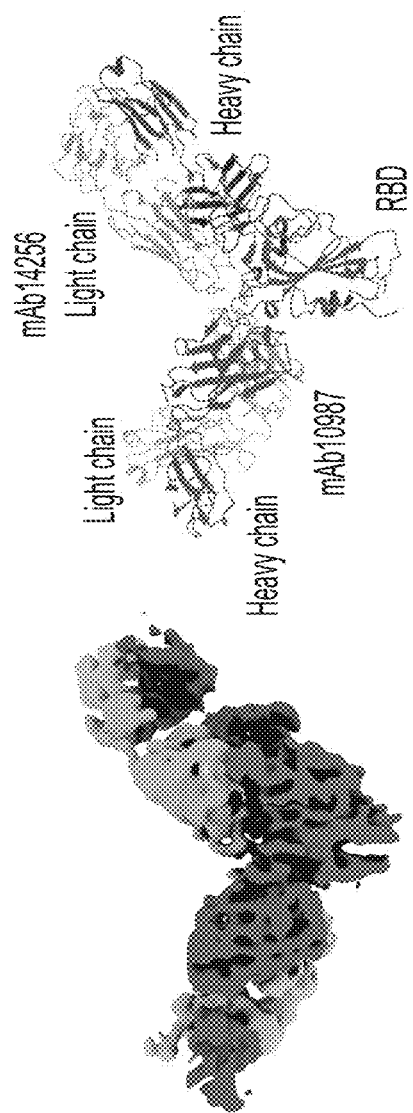
FIG. 3 depicts the cryo-EM structure of mAb14256, mAb10987, and the receptor binding domain (RBD) of the SARS-CoV-2 spike glycoprotein, in complex, at 3.9 Å resolution.

Before the present methods are described, it is to be understood that this invention is not limited to particular methods, and experimental conditions described, as such methods and conditions may vary. It is also to be understood that the terminology used herein is for the purpose of describing particular embodiments only, and is not intended to be limiting, since the scope of the present invention will be limited only by the appended claims.

Unless defined otherwise, all technical and scientific terms used herein have the same meaning as commonly understood by one of ordinary skill in the art to which this invention belongs. Although any methods and materials similar or equivalent to those described herein can be used in the practice or testing of the present invention, preferred methods and materials are now described. All publications mentioned herein are incorporated herein by reference in their entirety.

The term "coronavirus" or "CoV" refers to any virus of the coronavirus family, including but not limited to SARS-CoV-2, MERS-CoV, and SARS-CoV. SARS-CoV-2 has also been known as 2019-nCoV and Wuhan coronavirus. It binds via the viral spike protein to human host cell receptor angiotensin-converting enzyme 2 (ACE2). The spike protein also binds to and is cleaved by TMPRSS2, which activates the spike protein for membrane fusion of the virus.

The term "CoV-S", also called "S" or "S protein" refers to the spike protein of a coronavirus, and can refer to specific S proteins such as SARS-CoV-2-S, MERS-CoV S, and SARS-CoV S. The SARS-CoV-2-Spike protein is a 1273 amino acid type I membrane glycoprotein which assembles into trimers that constitute the spikes or peplomers on the surface of the enveloped coronavirus particle. The protein has two essential functions, host receptor binding and membrane fusion, which are attributed to the N-terminal (S1) and C-terminal (S2) halves of the S protein. CoV-S binds to its cognate receptor via a receptor binding domain (RBD) present in the S1 subunit. The amino acid sequence of full-length SARS-CoV-2 spike protein is exemplified by the amino acid sequence provided in SEQ ID NO: 1008. The term "CoV-S" includes protein variants of CoV spike protein isolated from different CoV isolates as well as recombinant CoV spike protein or a fragment thereof. The term also encompasses CoV spike protein or a fragment thereof coupled to, for example, a histidine tag, mouse or human Fc, or a signal sequence such as ROR1.

The term "coronavirus infection" or "CoV infection," as used herein, refers to infection with a coronavirus such as SARS-CoV-2, MERS-CoV, or SARS-CoV. The term includes coronavirus respiratory tract infections, often in the lower respiratory tract. Symptoms can include high fever, dry cough, shortness of breath, pneumonia, gastro-intestinal symptoms such as diarrhea, organ failure (kidney failure and renal dysfunction), septic shock, and death in severe cases. Viruses The present invention includes methods for treating or preventing a viral infection in a subject. The term "virus" includes any virus whose infection in the body of a subject is treatable or preventable by administration of an anti-CoV-S antibody or antigen-binding fragment thereof (e.g., wherein infectivity of the virus is at least partially dependent on CoV-S). In an embodiment of the invention, a "virus" is any virus that expresses spike protein (e.g., CoV-S). The term "virus" also includes a CoV-S-dependent respiratory virus which is a virus that infects the respiratory tissue of a subject (e.g., upper and/or lower respiratory tract, trachea, bronchi, lungs) and is treatable or preventable by administration of an anti-CoV-S antibody or antigen-binding fragment thereof. For example, in an embodiment of the invention, virus includes coronavirus, SARS-CoV-2 (severe acute respiratory syndrome coronavirus 2), SARS-CoV (severe acute respiratory syndrome coronavirus), and MERS-CoV (Middle East respiratory syndrome (MERS) coronavirus). Coronaviruses can include the genera of alphacoronaviruses, betacoronaviruses, gammacoronaviruses, and deltacoronaviruses. In some embodiments, the antibodies or antigen-binding fragments provided herein can bind to and/or neutralize an alphacoronavirus, a betacoronavirus, a gammacoronavirus, and/or a deltacoronavirus. In certain embodiments, this binding and/or neutralization can be specific for a particular genus of coronavirus or for a particular subgroup of a genus. "Viral infection" refers to the invasion and multiplication of a virus in the body of a subject.

Coronavirus virions are spherical with diameters of approximately 125 nm. The most prominent feature of coronaviruses is the club-shape spike projections emanating from the surface of the virion. These spikes are a defining feature of the virion and give them the appearance of a solar corona, prompting the name, coronaviruses. Within the envelope of the virion is the nucleocapsid. Coronaviruses have helically symmetrical nucleocapsids, which is uncommon among positive-sense RNA viruses, but far more common for negative-sense RNA viruses. SARS-CoV-2, MERS-CoV, and SARS-CoV belong to the coronavirus family. The initial attachment of the virion to the host cell is initiated by interactions between the S protein and its receptor. The sites of receptor binding domains (RBD) within the S1 region of a coronavirus S protein vary depending on the virus, with some having the RBD at the C-terminus of S1. The S-protein/receptor interaction is the primary determinant for a coronavirus to infect a host species and also governs the tissue tropism of the virus. Many coronaviruses utilize peptidases as their cellular receptor. Following receptor binding, the virus must next gain access to the host cell cytosol. This is generally accomplished by acid-dependent proteolytic cleavage of S protein by a cathepsin, TMPRRS2 or another protease, followed by fusion of the viral and cellular membranes.

The coronaviruses described herein also include variant coronaviruses, which in some embodiments are classified as "variants of interest" or "variants of concern" by the World Health Organization (WHO). Variant coronaviruses can have mutations in their spike glycoprotein, which may change the virus's properties such as severity of COVID-19 or transmissibility. WHO defines a variant of concern as one that is associated with one or more of the following changes from wild-type, to such a degree that it is a matter of global public health significance: 1) increased transmissibility or detrimental change in COVID-19 epidemiology; 2) increased virulence or changed clinical disease presentation; or 3) decreased effectiveness of public health measures and social measures, including available therapeutics, vaccines, and diagnostics. Variants of interest are defined by WHO as SARS-CoV-2 viruses 1) with genetic changes that are predicted or have been demonstrated to affect virus characteristics including immune escape, therapeutic escape, diagnostic escape, transmissibility, and disease severity; and 2) that have been identified as causing significant community transmission or multiple COVID-19 clusters, in multiple countries and with increasing relative prevalence alongside an increasing number of cases over time, or with other epidemiological impacts that suggest an emerging risk to global public health. As of Dec. 13, 2021, there are five variants of concern as classified by WHO (alpha, beta, gamma, delta, and omicron), and two variants of interest as classified by WHO (lambda and mu). Each variant can be defined by the mutations in its spike glycoprotein as compared to the wild-type spike glycoprotein. For example, the Omicron variant (also classified as B.1.1.529) comprises the following mutations in its spike glycoprotein: A67V, Δ69-70, T95I, G142D/Δ143-145, Δ211/L212I, ins214EPE, G339D, S371L, S373P, S375F, K417N, N440K, G446S, S477N, T478K, E484A, Q493R, G496S, Q498R, N501Y, Y505H, T547K, D614G, H655Y, N679K, P681H, N764K, D796Y, N856K, Q954H, N969K, and L981F (full length omicron spike glycoprotein: SEQ ID NO: 1072). Moreover, these variants may have further lineages that encompass a group of related viruses. For example, as of Jul. 8, 2022, the Omicron variant has BA.1, BA.1.1, BA.2, BA.2.12.1, BA.3, and BA.4/ BA.5 lineages. In some embodiments, the antibodies and antigen-binding fragments thereof described herein can bind to any of these variants and/or lineages. In further embodiments, the antibodies and antigen-binding fragments thereof can neutralize these variants and/or lineages.

Anti-CoV-S Antibodies and Antigen-Binding Fragments

The present invention provides antigen-binding proteins, such as antibodies and antigen-binding fragments thereof, that specifically bind to CoV spike protein or an antigenic fragment thereof.

The term "antibody", as used herein, refers to immunoglobulin molecules comprising four polypeptide chains, two heavy chains (HCs) and two light chains (LCs) inter-connected by disulfide bonds (i.e., "full antibody molecules"), as well as multimers thereof (e.g. IgM). Exemplary antibodies include, for example, those listed in Table 4. Each heavy chain comprises a heavy chain variable region ("HCVR" or "$V_H$") and a heavy chain constant region (comprised of domains $C_H1$, $C_H2$ and $C_H3$). Each light chain is comprised of a light chain variable region ("LCVR or "$V_L$") and a light chain constant region ($C_L$). The $V_H$ and $V_L$ regions can be further subdivided into regions of hypervariability, termed complementarity determining regions (CDR), interspersed with regions that are more conserved, termed framework regions (FR). Each $V_H$ and $V_L$ comprises three CDRs and four FRs, arranged from amino-terminus to carboxy-terminus in the following order: FR1, CDR1, FR2, CDR2, FR3, CDR3, FR4. Heavy chain CDRs can also be referred to as HCDRs or CDR-Hs, and numbered as described above (e.g., HCDR1, HCDR2, and HCDR3 or HCDR1, HCDR2, and HCDR3). Likewise, light chain CDRs can be referred to as LCDRs or CDR-Ls, and numbered LCDR1, LCDR2, and LCDR3, or LCDR1, LCDR2, and LCDR3. In certain embodiments of the invention, the FRs of the antibody (or antigen binding fragment thereof) are identical to the human germline sequences, or are naturally or artificially modified. Exemplary human germline sequences include, but are not limited to, VH3-66 and Vk1-33. Thus, the present disclosure provides anti-CoV-S antibodies or antigen-binding fragments thereof (e.g., anti-SARS-CoV-2-S antibodies or antigen-binding fragments thereof) comprising HCDR and LCDR sequences of Table 4 within a VH3-66 or Vk1-33 variable heavy chain or light chain region. The present disclosure further provides anti-CoV-S antibodies or antigen-binding fragments thereof (e.g., anti-SARS-CoV-2-S antibodies or antigen-binding fragments thereof) comprising HCDR and LCDR sequences of Table 4 within a combination of a light chain selected from IgKV4-1, IgKV1-5, IgKV1-9, IgKV1-12, IgKV3-15, IgKV1-16, IgKV1-17, IgKV3-20, IgLV3-21, IgKV2-24, IgKV1-33, IgKV1-39, IgLV1-40, IgLV1-44, IgLV1-51, IgLV3-1, IgKV1-6, IgLV2-8, IgKV3-11, IgLV2-11, IgLV2-14, IgLV2-23, or IgLV6-57, and a heavy chain selected from IgHV1-69, IgHV3-64, IgHV4-59, IgHV3-53, IgHV3-48, IgHV4-34, IgHV3-33, IgHV3-30, IgHV3-23, IgHV3-20, IgHV1-18, IgHV3-15, IgHV3-11, IgHV3-9, IgHV1-8, IgHV3-7, IgHV2-5, IgHV1-2, IgHV2-70, IgHV3-66, IgHV5-51, IgHV1-46, IgHV4-39, IgHV4-31, IgHV3-30-3, IgHV2-26, or IgHV7-4-1. The present disclosure further provides anti-CoV-S antibodies or antigen-binding fragments thereof (e.g., anti-SARS-CoV-2-S antibodies or antigen-binding fragments thereof) comprising HCVR and LCVR sequences of Table 4 within a combination of a light chain selected from IgKV4-1, IgKV1-5, IgKV1-9, IgKV1-12, IgKV3-15, IgKV1-16, IgKV1-17, IgKV3-20, IgLV3-21, IgKV2-24, IgKV1-33, IgKV1-39, IgLV1-40, IgLV1-44, IgLV1-51, IgLV3-1, IgKV1-6, IgLV2-8, IgKV3-11, IgLV2-11, IgLV2-14, IgLV2-23, or IgLV6-57, and a heavy chain selected from IgHV1-69, IgHV3-64, IgHV4-59, IgHV3-53, IgHV3-48, IgHV4-34, IgHV3-33, IgHV3-30, IgHV3-23, IgHV3-20, IgHV1-18, IgHV3-15, IgHV3-11, IgHV3-9, IgHV1-8, IgHV3-7, IgHV2-5, IgHV1-2, IgHV2-70, IgHV3-

66, IgHV5-51, IgHV1-46, IgHV4-39, IgHV4-31, IgHV3-30-3, IgHV2-26, or IgHV7-4-1.

Typically, the variable domains of both the heavy and light immunoglobulin chains comprise three hypervariable regions, also called complementarity determining regions (CDRs), located within relatively conserved framework regions (FR). In general, from N-terminal to C-terminal, both light and heavy chains variable domains comprise FR1, CDR1, FR2, CDR2, FR3, CDR3 and FR4. In an embodiment of the invention, the assignment of amino acids to each domain is in accordance with the definitions of Sequences of Proteins of Immunological Interest, Kabat, et al.; National Institutes of Health, Bethesda, Md.; 5$^{th}$ ed.; NIH Publ. No. 91-3242 (1991); Kabat (1978) Adv. Prot. Chem. 32:1-75; Kabat, et al., (1977) J. Biol. Chem. 252:6609-6616; Chothia, et al., (1987) J Mol. Biol. 196:901-917 or Chothia, et al., (1989) Nature 342:878-883.

The present invention includes monoclonal anti-CoV-S antigen-binding proteins, e.g., antibodies and antigen-binding fragments thereof, as well as monoclonal compositions comprising a plurality of isolated monoclonal antigen-binding proteins. The term "monoclonal antibody", as used herein, refers to a population of substantially homogeneous antibodies, i.e., the antibody molecules comprising the population are identical in amino acid sequence except for possible naturally occurring mutations that may be present in minor amounts. A "plurality" of such monoclonal antibodies and fragments in a composition refers to a concentration of identical (i.e., as discussed above, in amino acid sequence except for possible naturally occurring mutations that may be present in minor amounts) antibodies and fragments which is above that which would normally occur in nature, e.g., in the blood of a host organism such as a mouse or a human.

In an embodiment of the invention, an anti-CoV-S antigen-binding protein, e.g., antibody or antigen-binding fragment comprises a heavy chain constant domain, e.g., of the type IgA (e.g., IgA1 or IgA2), IgD, IgE, IgG (e.g., IgG1, IgG2, IgG3 and IgG4) or IgM. In an embodiment of the invention, an antigen-binding protein, e.g., antibody or antigen-binding fragment comprises a light chain constant domain, e.g., of the type kappa or lambda.

The term "human" antigen-binding protein, such as an antibody, as used herein, includes antibodies having variable and constant regions derived from human germline immunoglobulin sequences whether in a human cell or grafted into a non-human cell, e.g., a mouse cell. See e.g., U.S. Pat. Nos. 8,502,018, 6,596,541 or 5,789,215. The human mAbs of the invention may include amino acid residues not encoded by human germline immunoglobulin sequences (e.g., mutations introduced by random or site-specific mutagenesis in vitro or by somatic mutation in vivo), for example in the CDRs and, in particular, CDR3. However, the term "human antibody", as used herein, is not intended to include mAbs in which CDR sequences derived from the germline of another mammalian species (e.g., mouse) have been grafted onto human FR sequences. The term includes antibodies recombinantly produced in a non-human mammal or in cells of a non-human mammal. The term is not intended to include antibodies isolated from or generated in a human subject. See below.

The present invention includes anti-CoV-S chimeric antigen-binding proteins, e.g., antibodies and antigen-binding fragments thereof, and methods of use thereof. As used herein, a "chimeric antibody" is an antibody having the variable domain from a first antibody and the constant domain from a second antibody, where the first and second antibodies are from different species. (U.S. Pat. No. 4,816,567; and Morrison et al., (1984) Proc. Natl. Acad. Sci. USA 81: 6851-6855).

The present invention includes anti-CoV-S hybrid antigen-binding proteins, e.g., antibodies and antigen-binding fragments thereof, and methods of use thereof. As used herein, a "hybrid antibody" is an antibody having the variable domain from a first antibody and the constant domain from a second antibody, wherein the first and second antibodies are from different animals, or wherein the variable domain, but not the constant region, is from a first animal. For example, a variable domain can be taken from an antibody isolated from a human and expressed with a fixed constant region not isolated from that antibody. Exemplary hybrid antibodies are described in Example 1, which refers to antibody heavy chain variable region and light chain variable region derived PCR products that were cloned into expression vectors containing a heavy constant region and a light constant region, respectively. Hybrid antibodies are synthetic and non-naturally occurring because the variable and constant regions they contain are not isolated from a single natural source.

The term "recombinant" antigen-binding proteins, such as antibodies or antigen-binding fragments thereof, refers to such molecules created, expressed, isolated or obtained by technologies or methods known in the art as recombinant DNA technology which include, e.g., DNA splicing and transgenic expression. The term includes antibodies expressed in a non-human mammal (including transgenic non-human mammals, e.g., transgenic mice), or a cell (e.g., CHO cells) expression system, or a non-human cell expression system, or isolated from a recombinant combinatorial human antibody library. In some embodiments, a recombinant antibody shares a sequence with an antibody isolated from an organism (e.g., a mouse or a human), but has been expressed via recombinant DNA technology. Such antibodies may have post-translational modifications (e.g., glycosylation) that differ from the antibody as isolated from the organism.

In some embodiments, the antibodies disclosed herein lack fucose in its constant region glycosylation. Methods of measuring fucose in an antibody composition have been described in the art, e.g., U.S. Pat. No. 8,409,838 (Regeneron Pharmaceuticals), incorporated herein by reference. In some embodiments, fucose is undetectable in a composition comprising a population of antibody molecules. In some embodiments, an antibody lacking fucose has enhanced ADCC activity.

In some embodiments, antibodies that lack fucose can be produced using cell lines that are deficient in their ability to fucosylate proteins, i.e., the ability to fucosylate proteins is reduced or eliminated. Fucosylation of glycans requires synthesis of GDP-fucose via the de novo pathway or the salvage pathway, both of which involve sequential function of several enzymes, leading to addition of a fucose molecule to the first N-acetylglucosamine (GlcNAc) moiety of the reducing end of a glycan. The two key enzymes of the de novo pathway responsible for production of GDP-fucose are GDP-D-mannose-4,6-dehydratase (GMD) and GDP-keto-6-deoxymannose-3,5-epimerase,4-reductase (FX). In the absence of fucose, these two de novo pathway enzymes (GMD and FX) convert mannose and/or glucose to GDP-fucose which is then transported into the Golgi complex where nine fucosyl-transferases (FUT1-9) act in concert to fucosylate the first GlcNAc molecule of a glycan. In the presence of fucose, however, the salvage pathway enzymes, fucose-kinase and GDP-fucose pyrophosphorylase, convert fucose into GDP-fucose.

Cell lines that are deficient in their ability to fucosylate proteins have been described in the art. In some embodiments, a cell line deficient in its ability to fucosylate proteins is a mammalian cell line (e.g., CHO cell lines, such as CHO K1, DXB-11 CHO, Veggie-CHO) comprising a mutation or genetic modification in one or more of endogenous FUT1 to 9 genes resulting in a lack of one or more functional fucosyl-transferases. In some embodiments, the mammalian cell line comprises a mutation in an endogenous FUT8 gene (e.g., a FUT8 knock-out cell line in which the FUT8 gene has been disrupted resulting in a lack of a functional ☐1,6-fucosyltransferase in the cell line, as described in U.S. Pat. No. 7,214,775 (Kyowa Hakko Kogyo Co., Ltd.) and U.S. Pat. No. 7,737,725 (Kyowa Hakko Kirin Co., Ltd), incorporated herein by reference. In some embodiments, the mammalian cell line comprises a mutation or genetic modification in an endogenous GMD gene resulting in a lack of a functional GMD in the cell line, e.g., a GMD knock-out cell line in which the GMD gene has been disrupted, described in e.g., U.S. Pat. No. 7,737,725 (Kyowa Hakko Kirin Co., Ltd), incorporated herein by reference. In some embodiments, the mammalian cell line comprises a mutation or genetic modification in an endogenous Fx gene resulting in a lack of a functional Fx protein. In some embodiments, the mammalian cell line is an Fx knock-out cell line in which the endogenous Fx gene has been disrupted (see, e.g., U.S. Pat. No. 7,737,725 (Kyowa Hakko Kirin Co., Ltd), incorporated herein by reference). In some embodiments, the mammalian cell line comprises a mutation in an endogenous Fx mutation that confers temperature sensitive phenotypes (as described in, e.g., U.S. Pat. No. 8,409,838 (Regeneron Pharmaceuticals), incorporated herein by reference). In some embodiments, the mammalian cell line deficient in its ability to fucosylate proteins is a cell line that has been selected based on resistance to certain lectins, e.g., the Lens culinaris lectin. See, e.g., U.S. Pat. No. 8,409,838 (Regeneron Pharmaceuticals), incorporated herein by reference.

Recombinant anti-CoV-S antigen-binding proteins, e.g., antibodies and antigen-binding fragments, disclosed herein may also be produced in an *E. coli*/ T7 expression system. In this embodiment, nucleic acids encoding the anti-CoV-S antibody immunoglobulin molecules of the invention (e.g., as found in Table 4) may be inserted into a pET-based plasmid and expressed in the *E. coli*/T7 system. For example, the present invention includes methods for expressing an antibody or antigen-binding fragment thereof or immunoglobulin chain thereof in a host cell (e.g., bacterial host cell such as *E. coli* such as BL21 or BL21DE3) comprising expressing T7 RNA polymerase in the cell which also includes a polynucleotide encoding an immunoglobulin chain that is operably linked to a T7 promoter. For example, in an embodiment of the invention, a bacterial host cell, such as an *E. coli*, includes a polynucleotide encoding the T7 RNA polymerase gene operably linked to a lac promoter and expression of the polymerase and the chain is induced by incubation of the host cell with IPTG (isopropyl-beta-D-thiogalactopyranoside). See U.S. Pat. Nos. 4,952,496 and 5,693,489 or Studier & Moffatt, Use of bacteriophage T7 RNA polymerase to direct selective high-level expression of cloned genes, J. Mol. Biol. 1986 May 5; 189(1): 113-30.

There are several methods by which to produce recombinant antibodies which are known in the art. One example of a method for recombinant production of antibodies is disclosed in U.S. Pat. No. 4,816,567.

Transformation can be by any known method for introducing polynucleotides (e.g., DNA or RNA, including mRNA) into a host cell. Methods for introduction of heterologous polynucleotides into mammalian cells are well known in the art and include dextran-mediated transfection, calcium phosphate precipitation, polybrene-mediated transfection, protoplast fusion, electroporation, encapsulation of the polynucleotide(s) in liposomes, lipid nanoparticle technology, biolistic injection and direct microinjection of the DNA into nuclei. In addition, nucleic acid molecules may be introduced into mammalian cells by viral vectors such as lentivirus or adeno-associated virus. Methods of transforming cells are well known in the art. See, for example, U.S. Pat. Nos. 4,399,216; 4,912,040; 4,740,461 and 4,959,455. In some embodiments, an antibody or antigen-binding fragment thereof of the present disclosure can be introduced to a subject in nucleic acid form (e.g., DNA or RNA, including mRNA), such that the subject's own cells produce the antibody. The present disclosure further provides modifications to nucleotide sequences encoding the anti-CoV-S antibodies described herein that result in increased antibody expression, increased antibody stability, increased nucleic acid (e.g., mRNA) stability, or improved affinity or specificity of the antibodies for the CoV spike protein.

Thus, the present invention includes recombinant methods for making an anti-CoV-S antigen-binding protein, such as an antibody or antigen-binding fragment thereof of the present invention, or an immunoglobulin chain thereof, comprising (i) introducing one or more polynucleotides (e.g., including the nucleotide sequence of any one or more of the sequences of Table 5) encoding light and/or heavy immunoglobulin chains, or CDRs, of the antigen-binding protein, e.g., of Table 4, for example, wherein the polynucleotide is in a vector; and/or integrated into a host cell chromosome and/or is operably linked to a promoter; (ii) culturing the host cell (e.g., CHO or *Pichia* or *Pichia pastoris*) under condition favorable to expression of the polynucleotide and, (iii) optionally, isolating the antigen-binding protein, (e.g., antibody or fragment) or chain from the host cell and/or medium in which the host cell is grown. For example, a polynucleotide can be integrated into a host cell chromosome through targeted insertion with a vector such as adeno-associated virus (AAV), e.g., after cleavage of the chromosome using a gene editing system (e.g., CRISPR (for example, CRISPR-Cas9), TALEN, megaTAL, zinc finger, or Argonaute). Targeted insertions can take place, for example, at host cell loci such as an albumin or immunoglobulin genomic locus. Alternatively, insertion can be at a random locus, e.g., using a vector such as lentivirus. When making an antigen-binding protein (e.g., antibody or antigen-binding fragment) comprising more than one immunoglobulin chain, e.g., an antibody that comprises two heavy immunoglobulin chains and two light immunoglobulin chains, co-expression of the chains in a single host cell leads to association of the chains, e.g., in the cell or on the cell surface or outside the cell if such chains are secreted, so as to form the antigen-binding protein (e.g., antibody or antigen-binding fragment). The methods include those wherein only a heavy immunoglobulin chain or only a light immunoglobulin chain (e.g., any of those discussed herein including mature fragments and/or variable domains thereof) is expressed. Such chains are useful, for example, as intermediates in the expression of an antibody or antigen-binding fragment that includes such a chain. For example, the present invention also includes anti-CoV-S antigen-binding proteins, such as antibodies and antigen-binding fragments thereof, comprising a heavy chain immunoglobulin (or variable domain thereof or comprising the CDRs thereof) encoded by a polynucleotide comprising a nucleotide sequence set forth in Table 5 and a light chain immunoglobulin (or variable domain thereof or comprising the CDRs thereof) encoded by a nucleotide sequence set forth in Table 5 which are the product of such production methods, and, optionally, the purification methods set forth herein. For example, in some embodiments, the product of the method is an anti-CoV-S antigen-binding protein which is an antibody or fragment comprising an HCVR comprising an amino acid sequence set forth in Table 4 and an LCVR comprising an amino acid sequence set forth in Table 4, wherein the HCVR and LCVR sequences are selected from a single antibody listed in Table 4. In some embodiments, the product of the method is an anti-CoV-S antigen-binding protein which is an antibody or fragment comprising HCDR1, HCDR2, and HCDR3 comprising amino acid sequences set forth in Table 4 and LCDR1, LCDR2, and LCDR3 comprising amino acid sequences set forth in Table 4, wherein the six CDR sequences are selected from a single antibody listed in Table 4. In some embodiments, the product of the method is an anti-CoV-S antigen-binding protein which is an antibody or fragment comprising a heavy chain comprising an HC amino acid sequence set forth in Table 4 and a light chain comprising an LC amino acid sequence set forth in Table 4.

Eukaryotic and prokaryotic host cells, including mammalian cells, may be used as hosts for expression of an anti-CoV-S antigen-binding protein. Such host cells are well known in the art and many are available from the American Type Culture Collection (ATCC). These host cells include, inter alia, Chinese hamster ovary (CHO) cells, NS0, SP2 cells, HeLa cells, baby hamster kidney (BHK) cells, monkey kidney cells (COS), human hepatocellular carcinoma cells (e.g., Hep G2), A549 cells, 3T3 cells, HEK-293 cells and a number of other cell lines. Mammalian host cells include human, mouse, rat, dog, monkey, pig, goat, bovine, horse and hamster cells. Other cell lines that may be used are insect cell lines (e.g., *Spodoptera frugiperda* or *Trichoplusia ni*), amphibian cells, bacterial cells, plant cells and fungal cells. Fungal cells include yeast and filamentous fungus cells including, for example, *Pichia pastoris, Pichia finlandica, Pichia trehalophila, Pichia koclamae, Pichia membranaefaciens, Pichia minuta* (*Ogataea minuta, Pichia lindneri*), *Pichia opuntiae, Pichia thermotolerans, Pichia salictaria, Pichia guercuum, Pichia pijperi, Pichia stiptis, Pichia methanolica, Pichia* sp., *Saccharomyces cerevisiae, Saccharomyces* sp., *Hansenula polymorpha, Kluyveromyces* sp., *Kluyveromyces lactis, Candida albicans, Aspergillus nidulans, Aspergillus niger, Aspergillus oryzae, Trichoderma reesei, Chrysosporium lucknowense, Fusarium* sp., *Fusarium gramineum, Fusarium venenatum, Physcomitrella patens* and *Neurospora crassa*. The present invention includes an isolated host cell (e.g., a CHO cell) comprising an antigen-binding protein, such as those of Table 4; or a polynucleotide encoding such a polypeptide thereof.

Polynucleotides, as discussed herein, may encode all or a portion of an antibody or antigen-binding fragment as discussed throughout the present disclosure. In some cases, a single polynucleotide may encode both a HCVR and a LCVR (e.g., defined with reference to the CDRs contained within the respective amino acid sequence-defined HCVR and LCVR, defined with reference to the amino acid sequences of the CDRs of the HCVR and LCVR. respectively, or defined with reference to the amino acid sequences of the HCVR and LCVR, respectively) of an antibody or antigen-binding fragment, or the HCVR and LCVR may be encoded by separate polynucleotides (i.e., a pair of polynucleotides). In the latter case, in which the HCVR and LCVR are encoded by separate polynucleotides, the polynucleotides may be combined in a single vector or may be contained in separate vectors (i.e., a pair of vectors). In any case, a host cell used to express the polynucleotide(s) or vector(s) may contain the full complement of component parts to generate the antibody or antigen-binding fragment thereof. For example, a host cell may comprise separate vectors, each encoding a HCVR and a LCVR, respectively, of an antibody or antigen-binding fragment thereof as discussed above or herein. Similarly, the polynucleotide or polynucleotides, and the vector or vectors, may be used to express the full-length heavy chain and full-length light chain of an antibody as discussed above or herein. For example, a host cell may comprise a single vector with polynucleotides encoding both a heavy chain and a light chain of an antibody, or the host cell may comprise separate vectors with polynucleotides encoding, respectively, a heavy chain and a light chain of an antibody as discussed above or herein.

In an exemplary embodiment, the present disclosure provides a polynucleotide (or a vector comprising the polynucleotide, or a host cell comprising the polynucleotide or the vector) encoding a HCVR comprising the HCDRs of SEQ ID NOs: 214, 216 and 218 (e.g., in an embodiment, the polynucleotide comprises SEQ ID NOs: 213, 215 and 217). In an exemplary embodiment, the present disclosure provides a polynucleotide (or a vector comprising the polynucleotide, or a host cell comprising the polynucleotide or the vector) encoding a LCVR comprising the LCDRs of SEQ ID NOs: 222, 126 and 224 (e.g., in an embodiment, the polynucleotide comprises SEQ ID NOs: 221, 125 and 223). In an exemplary embodiment, the present disclosure provides a polynucleotide (or a vector comprising the polynucleotide, or a host cell comprising the polynucleotide or the vector) encoding a HCVR comprising the amino acid sequence of SEQ ID NO: 212 (e.g., in an embodiment, the polynucleotide comprises SEQ ID NO: 211). In an exemplary embodiment, the present disclosure provides a polynucleotide (or a vector comprising the polynucleotide, or a host cell comprising the polynucleotide or the vector) encoding a LCVR comprising the amino acid sequence of SEQ ID NO: 220 (e.g., in an embodiment, the polynucleotide comprises SEQ ID NO: 219). In an exemplary embodiment, the present disclosure provides a polynucleotide (or a vector comprising the polynucleotide, or a host cell comprising the polynucleotide or the vector) encoding a heavy chain (HC) comprising the amino acid sequence of SEQ ID NO: 226 (e.g., in an embodiment, the polynucleotide comprises SEQ ID NO: 225). In an exemplary embodiment, the present disclosure provides a polynucleotide (or a vector comprising the polynucleotide, or a host cell comprising the polynucleotide or the vector) encoding a light chain (LC) comprising the amino acid sequence of SEQ ID NO: 228 (e.g., in an embodiment, the polynucleotide comprises SEQ ID NO: 227). In an embodiment, the present disclosure provides a pair of polynucleotides or a pair of vectors encoding, respectively, a HCVR and a LCVR, or a HC and a LC, as discussed in this paragraph, as well as a host cell containing the pair or polynucleotides and/or the pair of vectors to encode the antibody designated mAb14315 or an antigen-binding fragment thereof.

In an exemplary embodiment, the present disclosure provides a polynucleotide (or a vector comprising the polynucleotide, or a host cell comprising the polynucleotide or the vector) encoding a HCVR comprising the HCDRs of SEQ ID NOs: 364, 366 and 368 (e.g., in an embodiment, the polynucleotide comprises SEQ ID NOs: 363, 365 and 367). In an exemplary embodiment, the present disclosure provides a polynucleotide (or a vector comprising the polynucleotide, or a host cell comprising the polynucleotide or the vector) encoding a LCVR comprising the LCDRs of SEQ ID NOs: 372, 106 and 374 (e.g., in an embodiment, the polynucleotide comprises SEQ ID NOs: 371, 105 and 373). In an exemplary embodiment, the present disclosure provides a polynucleotide (or a vector comprising the polynucleotide, or a host cell comprising the polynucleotide or the vector) encoding a HCVR comprising the amino acid sequence of SEQ ID NO: 362 (e.g., in an embodiment, the polynucleotide comprises SEQ ID NO: 361). In an exemplary embodiment, the present disclosure provides a polynucleotide (or a vector comprising the polynucleotide, or a host cell comprising the polynucleotide or the vector) encoding a LCVR comprising the amino acid sequence of SEQ ID NO: 370 (e.g., in an embodiment, the polynucleotide comprises SEQ ID NO: 369). In an exemplary embodiment, the present disclosure provides a polynucleotide (or a vector comprising the polynucleotide, or a host cell comprising the polynucleotide or the vector) encoding a heavy chain (HC) comprising the amino acid sequence of SEQ ID NO: 376 (e.g., in an embodiment, the polynucleotide comprises SEQ ID NO: 375). In an exemplary embodiment, the present disclosure provides a polynucleotide (or a vector comprising the polynucleotide, or a host cell comprising the polynucleotide or the vector) encoding a light chain (LC) comprising the amino acid sequence of SEQ ID NO: 378 (e.g., in an embodiment, the polynucleotide comprises SEQ ID NO: 377). In an embodiment, the present disclosure provides a pair of polynucleotides or a pair of vectors encoding, respectively, a HCVR and a LCVR, or a HC and a LC, as discussed in this paragraph, as well as a host cell containing the pair or polynucleotides and/or the pair of vectors to encode the antibody designated mAb15160 or an antigen-binding fragment thereof.

In an exemplary embodiment, the present disclosure provides a polynucleotide (or a vector comprising the polynucleotide, or a host cell comprising the polynucleotide or the vector) encoding a HCVR comprising the HCDRs of SEQ ID NOs: 495, 497 and 499 (e.g., in an embodiment, the polynucleotide comprises SEQ ID NOs: 494, 496 and 498). In an exemplary embodiment, the present disclosure provides a polynucleotide (or a vector comprising the polynucleotide, or a host cell comprising the polynucleotide or the vector) encoding a LCVR comprising the LCDRs of SEQ ID NOs: 503, 505 and 507 (e.g., in an embodiment, the polynucleotide comprises SEQ ID NOs: 502, 504 and 506). In an exemplary embodiment, the present disclosure provides a polynucleotide (or a vector comprising the polynucleotide, or a host cell comprising the polynucleotide or the vector) encoding a HCVR comprising the amino acid sequence of SEQ ID NO: 493 (e.g., in an embodiment, the polynucleotide comprises SEQ ID NO: 492). In an exemplary embodiment, the present disclosure provides a polynucleotide (or a vector comprising the polynucleotide, or a host cell comprising the polynucleotide or the vector) encoding a LCVR comprising the amino acid sequence of SEQ ID NO: 501 (e.g., in an embodiment, the polynucleotide comprises SEQ ID NO: 500). In an exemplary embodiment, the present disclosure provides a polynucleotide (or a vector comprising the polynucleotide, or a host cell comprising the polynucleotide or the vector) encoding a heavy chain (HC) comprising the amino acid sequence of SEQ ID NO: 509 (e.g., in an embodiment, the polynucleotide comprises SEQ ID NO: 508). In an exemplary embodiment, the present disclosure provides a polynucleotide (or a vector comprising the polynucleotide, or a host cell comprising the polynucleotide or the vector) encoding a light chain (LC) comprising the amino acid sequence of SEQ ID NO: 511 (e.g., in an embodiment, the polynucleotide comprises SEQ ID NO: 510). In an embodiment, the present disclosure provides a pair of polynucleotides or a pair of vectors encoding, respectively, a HCVR and a LCVR, or a HC and a LC, as discussed in this paragraph, as well as a host cell containing the pair or polynucleotides and/or the pair of vectors to encode the antibody designated mAb14284 or an antigen-binding fragment thereof.

In an exemplary embodiment, the present disclosure provides a polynucleotide (or a vector comprising the polynucleotide, or a host cell comprising the polynucleotide or the vector) encoding a HCVR comprising the HCDRs of SEQ ID NOs: 889, 891 and 893 (e.g., in an embodiment, the polynucleotide comprises SEQ ID NOs: 888, 890 and 892). In an exemplary embodiment, the present disclosure provides a polynucleotide (or a vector comprising the polynucleotide, or a host cell comprising the polynucleotide or the vector) encoding a LCVR comprising the LCDRs of SEQ ID NOs: 897, 164 and 899 (e.g., in an embodiment, the polynucleotide comprises SEQ ID NOs: 896, 163 and 898). In an exemplary embodiment, the present disclosure provides a polynucleotide (or a vector comprising the polynucleotide, or a host cell comprising the polynucleotide or the vector) encoding a HCVR comprising the amino acid sequence of SEQ ID NO: 887 (e.g., in an embodiment, the polynucleotide comprises SEQ ID NO: 886). In an exemplary embodiment, the present disclosure provides a polynucleotide (or a vector comprising the polynucleotide, or a host cell comprising the polynucleotide or the vector) encoding a LCVR comprising the amino acid sequence of SEQ ID NO: 895 (e.g., in an embodiment, the polynucleotide comprises SEQ ID NO: 894). In an exemplary embodiment, the present disclosure provides a polynucleotide (or a vector comprising the polynucleotide, or a host cell comprising the polynucleotide or the vector) encoding a heavy chain (HC) comprising the amino acid sequence of SEQ ID NO: 901 (e.g., in an embodiment, the polynucleotide comprises SEQ ID NO: 900). In an exemplary embodiment, the present disclosure provides a polynucleotide (or a vector comprising the polynucleotide, or a host cell comprising the polynucleotide or the vector) encoding a light chain (LC) comprising the amino acid sequence of SEQ ID NO: 903 (e.g., in an embodiment, the polynucleotide comprises SEQ ID NO: 902). In an embodiment, the present disclosure provides a pair of polynucleotides or a pair of vectors encoding, respectively, a HCVR and a LCVR, or a HC and a LC, as discussed in this paragraph, as well as a host cell containing the pair or polynucleotides and/or the pair of vectors to encode the antibody designated mAb14256 or an antigen-binding fragment thereof.

In an exemplary embodiment, the present disclosure provides a polynucleotide (or a vector comprising the polynucleotide, or a host cell comprising the polynucleotide or the vector) encoding a HCVR comprising the HCDRs of SEQ ID NOs: 495, 497 and 499 (e.g., in an embodiment, the polynucleotide comprises SEQ ID NOs: 494, 496 and 498). In an exemplary embodiment, the present disclosure provides a polynucleotide (or a vector comprising the polynucleotide, or a host cell comprising the polynucleotide or the vector) encoding a LCVR comprising the LCDRs of SEQ ID NOs: 503, 505 and 507 (e.g., in an embodiment, the polynucleotide comprises SEQ ID NOs: 502, 504 and 506). In an exemplary embodiment, the present disclosure provides a polynucleotide (or a vector comprising the polynucleotide, or a host cell comprising the polynucleotide or the vector) encoding a HCVR comprising the amino acid sequence of SEQ ID NO: 493 (e.g., in an embodiment, the polynucleotide comprises SEQ ID NO: 492). In an exemplary embodiment, the present disclosure provides a polynucleotide (or a vector comprising the polynucleotide, or a host cell comprising the polynucleotide or the vector) encoding a LCVR comprising the amino acid sequence of SEQ ID NO: 501 (e.g., in an embodiment, the polynucleotide comprises SEQ ID NO: 500). In an exemplary embodiment, the present disclosure provides a polynucleotide (or a vector comprising the polynucleotide, or a host cell comprising the polynucleotide or the vector) encoding a heavy chain (HC) comprising the amino acid sequence of SEQ ID NO: 1075 (e.g., in an embodiment, the polynucleotide comprises SEQ ID NO: 1074). In an exemplary embodiment, the present disclosure provides a polynucleotide (or a vector comprising the polynucleotide, or a host cell comprising the polynucleotide or the vector) encoding a light chain (LC) comprising the amino acid sequence of SEQ ID NO: 511 (e.g., in an embodiment, the polynucleotide comprises SEQ ID NO: 510). In an embodiment, the present disclosure provides a pair of polynucleotides or a pair of vectors encoding, respectively, a HCVR and a LCVR, or a HC and a LC, as discussed in this paragraph, as well as a host cell containing the pair or polynucleotides and/or the pair of vectors to encode the antibody designated mAb17090 or an antigen-binding fragment thereof.

In an exemplary embodiment, the present disclosure provides a polynucleotide (or a vector comprising the polynucleotide, or a host cell comprising the polynucleotide or the vector) encoding a HCVR comprising the HCDRs of SEQ ID NOs: 364, 366 and 368 (e.g., in an embodiment, the polynucleotide comprises SEQ ID NOs: 363, 365 and 367). In an exemplary embodiment, the present disclosure provides a polynucleotide (or a vector comprising the polynucleotide, or a host cell comprising the polynucleotide or the vector) encoding a LCVR comprising the LCDRs of SEQ ID NOs: 372, 106 and 374 (e.g., in an embodiment, the polynucleotide comprises SEQ ID NOs: 371, 105 and 373). In an exemplary embodiment, the present disclosure provides a polynucleotide (or a vector comprising the polynucleotide, or a host cell comprising the polynucleotide or the vector) encoding a HCVR comprising the amino acid sequence of SEQ ID NO: 362 (e.g., in an embodiment, the polynucleotide comprises SEQ ID NO: 361). In an exemplary embodiment, the present disclosure provides a polynucleotide (or a vector comprising the polynucleotide, or a host cell comprising the polynucleotide or the vector) encoding a LCVR comprising the amino acid sequence of SEQ ID NO: 370 (e.g., in an embodiment, the polynucleotide comprises SEQ ID NO: 369). In an exemplary embodiment, the present disclosure provides a polynucleotide (or a vector comprising the polynucleotide, or a host cell comprising the polynucleotide or the vector) encoding a heavy chain (HC) comprising the amino acid sequence of SEQ ID NO: 1077 (e.g., in an embodiment, the polynucleotide comprises SEQ ID NO: 1076). In an exemplary embodiment, the present disclosure provides a polynucleotide (or a vector comprising the polynucleotide, or a host cell comprising the polynucleotide or the vector) encoding a light chain (LC) comprising the amino acid sequence of SEQ ID NO: 378 (e.g., in an embodiment, the polynucleotide comprises SEQ ID NO: 377). In an embodiment, the present disclosure provides a pair of polynucleotides or a pair of vectors encoding, respectively, a HCVR and a LCVR, or a HC and a LC, as discussed in this paragraph, as well as a host cell containing the pair or polynucleotides and/or the pair of vectors to encode the antibody designated mAb15160_2 or an antigen-binding fragment thereof.

The term "specifically binds" refers to those antigen-binding proteins (e.g., mAbs) having a binding affinity to an antigen, such as a CoV-S protein (e.g., SARS-CoV-2-S), expressed as $K_D$, of at least about $10^{-8}$M, as measured by real-time, label free bio-layer interferometry assay, for example, at 25° C. or 37° C., e.g., an Octet® HTX biosensor, or by surface plasmon resonance, e.g., BIACORE™, or by solution-affinity ELISA. The present invention includes antigen-binding proteins that specifically bind to a CoV-S protein.

The terms "antigen-binding portion" or "antigen-binding fragment" of an antibody or antigen-binding protein, and the like, as used herein, include any naturally occurring, enzymatically obtainable, synthetic, or genetically engineered polypeptide or glycoprotein that specifically binds an antigen to form a complex. Non-limiting examples of antigen-binding fragments include: (i) Fab fragments; (ii) $F(ab)_2$ fragments; (iii) Fd fragments; (iv) Fv fragments; (v) single-chain Fv (scFv) molecules; (vi) dAb fragments; and (vii) minimal recognition units consisting of the amino acid residues that mimic the hypervariable region of an antibody (e.g., an isolated complementarity determining region (CDR) such as a CDR3 peptide), or a constrained FR3-CDR3-FR4 peptide. Other engineered molecules, such as domain-specific antibodies, single domain antibodies, domain-deleted antibodies, chimeric antibodies, CDR-grafted antibodies, diabodies, triabodies, tetrabodies, minibodies, nanobodies (e.g., as defined in WO08/020079 or WO09/138519) (e.g., monovalent nanobodies, bivalent nanobodies, etc.), small modular immunopharmaceuticals (SMIPs), and shark variable IgNAR domains, are also encompassed within the expression "antigen-binding fragment," as used herein. In an embodiment of the invention, the antigen-binding fragment comprises three or more CDRs of an antibody of Table 4 (e.g., HCDR1, HCDR2 and HCDR3; or LCDR1, LCDR2 and LCDR3).

An antigen-binding fragment of an antibody will, in an embodiment of the invention, comprise at least one variable domain. The variable domain may be of any size or amino acid composition and will generally comprise at least one CDR, which is adjacent to or in frame with one or more framework sequences. In antigen-binding fragments having a $V_H$ domain associated with a $V_L$ domain, the $V_H$ and $V_L$ domains may be situated relative to one another in any suitable arrangement. For example, the variable region may be dimeric and contain $V_H$-$V_H$, $V_H$-$V_L$ or $V_L$-$V_L$ dimers. Alternatively, the antigen-binding fragment of an antibody may contain a monomeric $V_H$ or $V_L$ domain.

In certain embodiments, an antigen-binding fragment of an antibody may contain at least one variable domain covalently linked to at least one constant domain. Non-limiting, exemplary configurations of variable and constant domains that may be found within an antigen-binding fragment of an antibody of the present invention include: (i) $V_H$-$C_H$1; (ii) $V_H$-$C_H$2; (iii) $V_H$-$C_H$3; (iv) $V_H$-$C_H$1-$C_H$2; (v) $V_H$-$C_H$1-$C_H$2-$C_H$3; (vi) $V_H$-$C_H$2-$C_H$3; (vii) $V_H$-$C_L$; (viii) $V_L$-$C_H$1; (ix) $V_L$-$C_H$2; (x) $V_L$-$C_H$3; (xi) $V_L$-$C_H$1-$C_H$2; (xii) $V_L$-$C_H$1-$C_H$2-$C_H$3; (xiii) $V_L$-$C_H$2-$C_H$3; and (xiv) $V_L$-$C_L$. In any configuration of variable and constant domains, including any of the exemplary configurations listed above, the variable and constant domains may be either directly linked to one another or may be linked by a full or partial hinge or linker region. A hinge region may consist of at least 2 (e.g., 5, 10, 15, 20, 40, 60 or more) amino acids, which result in a flexible or semi-flexible linkage between adjacent variable and/or constant domains in a single polypeptide molecule. Moreover, an antigen-binding fragment of an antibody of the present invention may comprise a homo-dimer or hetero-dimer (or other multimer) of any of the variable and constant domain configurations listed above in non-covalent association with one another and/or with one or more monomeric $V_H$ or $V_L$ domain (e.g., by disulfide bond(s)).

Antigen-binding proteins (e.g., antibodies and antigen-binding fragments) may be mono-specific or multi-specific (e.g., bi-specific). Multispecific antigen-binding proteins are discussed further herein.

In specific embodiments, antibody or antibody fragments of the invention may be conjugated to a moiety such a ligand or a therapeutic moiety ("immunoconjugate"), such as an anti-viral drug, a second anti-influenza antibody, or any other therapeutic moiety useful for treating a viral infection, e.g., influenza viral infection. See below.

The present invention also provides a complex comprising an anti-CoV-S antigen-binding protein, e.g., antibody or antigen-binding fragment, discussed herein complexed with CoV-S polypeptide or an antigenic fragment thereof and/or with a secondary antibody or antigen-binding fragment thereof (e.g., detectably labeled secondary antibody) that binds specifically to the anti-CoV-S antibody or fragment. In an embodiment of the invention, the antibody or fragment is in vitro (e.g., is immobilized to a solid substrate) or is in the body of a subject. In an embodiment of the invention, the CoV-S is in vitro (e.g., is immobilized to a solid substrate) or is on the surface of a virus or is in the body of a subject. Immobilized anti-CoV-S antibodies and antigen-binding fragments thereof which are covalently linked to an insoluble matrix material (e.g., glass or polysaccharide such as agarose or sepharose, e.g., a bead or other particle thereof) are also part of the present invention; optionally, wherein the immobilized antibody is complexed with CoV-S or antigenic fragment thereof or a secondary antibody or fragment thereof.

"Isolated" antigen-binding proteins, antibodies or antigen-binding fragments thereof, polypeptides, polynucleotides and vectors, are at least partially free of other biological molecules from the cells or cell culture from which they are produced. Such biological molecules include nucleic acids, proteins, other antibodies or antigen-binding fragments, lipids, carbohydrates, or other material such as cellular debris and growth medium. An isolated antibody or antigen-binding fragment may further be at least partially free of expression system components such as biological molecules from a host cell or of the growth medium thereof. Generally, the term "isolated" is not intended to refer to a complete absence of such biological molecules or to an absence of water, buffers, or salts or to components of a pharmaceutical formulation that includes the antibodies or fragments.

The term "epitope" refers to an antigenic determinant (e.g., a CoV-S polypeptide) that interacts with a specific antigen-binding site of an antigen-binding protein, e.g., a variable region of an antibody molecule, known as a paratope. A single antigen may have more than one epitope. Thus, different antibodies may bind to different areas on an antigen and may have different biological effects. The term "epitope" also refers to a site on an antigen to which B and/or T cells respond. It also refers to a region of an antigen that is bound by an antibody. Epitopes may be defined as structural or functional. Functional epitopes are generally a subset of the structural epitopes and have those residues that directly contribute to the affinity of the interaction. Epitopes may be linear or conformational, that is, composed of non-linear amino acids. In certain embodiments, epitopes may include determinants that are chemically active surface groupings of molecules such as amino acids, sugar side chains, phosphoryl groups, or sulfonyl groups, and, in certain embodiments, may have specific three-dimensional structural characteristics, and/or specific charge characteristics.

Methods for determining the epitope of an antigen-binding protein, e.g., antibody or fragment or polypeptide, include alanine scanning mutational analysis, peptide blot analysis (Reineke (2004) Methods Mol. Biol. 248: 443-63), peptide cleavage analysis, crystallographic studies and NMR analysis. In addition, methods such as epitope excision, epitope extraction and chemical modification of antigens can be employed (Tomer (2000) Prot. Sci. 9: 487-496). Another method that can be used to identify the amino acids within a polypeptide with which an antigen-binding protein (e.g., antibody or fragment or polypeptide) (e.g., coversin) interacts is hydrogen/deuterium exchange detected by mass spectrometry. In general terms, the hydrogen/deuterium exchange method involves deuterium-labeling the protein of interest, followed by binding the antigen-binding protein, e.g., antibody or fragment or polypeptide, to the deuterium-labeled protein. Next, the CoV-S protein/antigen-binding protein complex is transferred to water and exchangeable protons within amino acids that are protected by the antibody complex undergo deuterium-to-hydrogen back-exchange at a slower rate than exchangeable protons within amino acids that are not part of the interface. As a result, amino acids that form part of the protein/antigen-binding protein interface may retain deuterium and therefore exhibit relatively higher mass compared to amino acids not included in the interface. After dissociation of the antigen-binding protein (e.g., antibody or fragment or polypeptide), the target protein is subjected to protease cleavage and mass spectrometry analysis, thereby revealing the deuterium-labeled residues which correspond to the specific amino acids with which the antigen-binding protein interacts. See, e.g., Ehring (1999) Analytical Biochemistry 267: 252-259; Engen and Smith (2001) Anal. Chem. 73: 256A-265A.

The term "competes" as used herein, refers to an antigen-binding protein (e.g., antibody or antigen-binding fragment thereof) that binds to an antigen (e.g., CoV-S) and inhibits or blocks the binding of another antigen-binding protein (e.g., antibody or antigen-binding fragment thereof) to the antigen. The term also includes competition between two antigen-binding proteins e.g., antibodies, in both orientations, i.e., a first antibody that binds and blocks binding of second antibody and vice versa. In certain embodiments, the first antigen-binding protein (e.g., antibody) and second antigen-binding protein (e.g., antibody) may bind to the same epitope. Alternatively, the first and second antigen-binding proteins (e.g., antibodies) may bind to different, but, for example, overlapping epitopes, wherein binding of one inhibits or blocks the binding of the second antibody, e.g., via steric hindrance. Competition between antigen-binding proteins (e.g., antibodies) may be measured by methods known in the art, for example, by a real-time, label-free bio-layer interferometry assay. Epitope mapping (e.g., via alanine scanning or hydrogen-deuterium exchange (HDX)) can be used to determine whether two or more antibodies are non-competing (e.g., on a spike protein receptor binding domain (RBD) monomer), competing for the same epitope, or competing but with diverse micro-epitopes (e.g., identified through HDX). In an embodiment of the invention, competition between a first and second anti-CoV-S antigen-binding protein (e.g., antibody) is determined by measuring the ability of an immobilized first anti-CoV-S antigen-binding protein (e.g., antibody) (not initially complexed with CoV-S protein) to bind to soluble CoV-S protein complexed with a second anti-CoV-S antigen-binding protein (e.g., antibody). A reduction in the ability of the first anti-CoV-S antigen-binding protein (e.g., antibody) to bind to the complexed CoV-S protein, relative to uncomplexed CoV-S protein, indicates that the first and second anti-CoV-S antigen-binding proteins (e.g., antibodies) compete. The degree of competition can be expressed as a percentage of the reduction in binding. Such competition can be measured using a real time, label-free bio-layer interferometry assay, e.g., on an Octet RED384 biosensor (Pall FortéBio Corp.), ELISA (enzyme-linked immunosorbent assays) or SPR (surface plasmon resonance).

Binding competition between anti-CoV-S antigen-binding proteins (e.g., monoclonal antibodies (mAbs)) can be determined using a real time, label-free bio-layer interferometry assay on an Octet RED384 biosensor (Pall FortéBio Corp.). For example, to determine competition between two anti-CoV-S monoclonal antibodies, the anti-CoV-S mAb can be first captured onto anti-hFc antibody coated Octet biosensor tips (Pall FortéBio Corp., #18-5060) by submerging the tips into a solution of anti-CoV-S mAb (subsequently referred to as "mAb1"). As a positive-control for blocking, the antibody captured biosensor tips can then be saturated with a known blocking isotype control mAb (subsequently referred to as "blocking mAb") by dipping into a solution of blocking mAb. To determine if mAb2 competes with mAb1, the biosensor tips can then be subsequently dipped into a co-complexed solution of CoV-S polypeptide and a second anti-CoV-S mAb (subsequently referred to as "mAb2"), that had been pre-incubated for a period of time and binding of mAb1 to the CoV-S polypeptide can be determined. The biosensor tips can be washed in buffer in between every step of the experiment. The real-time binding response can be monitored during the course of the experiment and the binding response at the end of every step can be recorded.

For example, in an embodiment of the invention, the competition assay is conducted at 25° C. and pH about 7, e.g., 7.4, e.g., in the presence of buffer, salt, surfactant and a non-specific protein (e.g., bovine serum albumin).

Typically, an antibody or antigen-binding fragment of the invention which is modified in some way retains the ability to specifically bind to CoV-S, e.g., retains at least 10% of its CoV-S binding activity (when compared to the parental antibody) when that activity is expressed on a molar basis. Preferably, an antibody or antigen-binding fragment of the invention retains at least 20%, 50%, 70%, 80%, 90%, 95% or 100% or more of the CoV-S binding affinity as the parental antibody. It is also intended that an antibody or antigen-binding fragment of the invention can include conservative or non-conservative amino acid substitutions (referred to as "conservative variants" or "function conserved variants" of the antibody) that do not substantially alter its biologic activity.

A "variant" of a polypeptide, such as an immunoglobulin chain (e.g., mAb8021 $V_H$, $V_L$, HC, or LC, mAb8028 $V_H$, $V_L$, HC, or LC, or mAb8029 $V_H$, $V_L$, HC, or LC), refers to a polypeptide comprising an amino acid sequence that is at least about 70-99.9% (e.g., 70, 72, 74, 75, 76, 79, 80, 81, 82, 83, 84, 85, 86, 87, 88, 89, 90, 91, 92, 93, 94, 95, 96, 97, 98, 99, 99.5, 99.9%) identical or similar to a referenced amino acid sequence that is set forth herein (e.g., SEQ ID NO: 2, 10, 18, 20, 22, 30, 38, 40, 42, 50, 58, or 60); when the comparison is performed by a BLAST algorithm wherein the parameters of the algorithm are selected to give the largest match between the respective sequences over the entire length of the respective reference sequences (e.g., expect threshold: 10; word size: 3; max matches in a query range: 0; BLOSUM 62 matrix; gap costs: existence 11, extension 1; conditional compositional score matrix adjustment).

A "variant" of a polynucleotide refers to a polynucleotide comprising a nucleotide sequence that is at least about 70-99.9% (e.g., at least about 70, 72, 74, 75, 76, 79, 80, 81, 82, 83, 84, 85, 86, 87, 88, 89, 90, 91, 92, 93, 94, 95, 96, 97, 98, 99, 99.5, or 99.9%) identical to a referenced nucleotide sequence that is set forth herein (e.g., SEQ ID NO: 1, 9, 17, 19, 21, 29, 37, 39, 41, 49, 57, or 59); when the comparison is performed by a BLAST algorithm wherein the parameters of the algorithm are selected to give the largest match between the respective sequences over the entire length of the respective reference sequences (e.g., expect threshold: 10; word size: 28; max matches in a query range: 0; match/mismatch scores: 1, -2; gap costs: linear).

Anti-CoV-S antigen-binding proteins, e.g., antibodies and antigen-binding fragments thereof of the present invention, in an embodiment of the invention, include a heavy chain immunoglobulin variable region having at least 70% (e.g., 80%, 85%, 90%, 91%, 92%, 93%, 94%, 95%, 96%, 97%, 98%, 99%, or greater) amino acid sequence identity to the HCVR amino acid sequences set forth in Table 4; and/or a light chain immunoglobulin variable region having at least 70% (e.g., 80%, 85%, 90%, 91%, 92%, 93%, 94%, 95%, 96%, 97%, 98%, 99%, or greater) amino acid sequence identity to the LCVR amino acid sequences set forth in Table 4.

In addition, a variant anti-CoV-S antigen-binding protein may include a polypeptide comprising an amino acid sequence that is set forth herein except for one or more (e.g., 1, 2, 3, 4, 5, 6, 7, 8, 9 or 10) mutations such as, for example, missense mutations (e.g., conservative substitutions), nonsense mutations, deletions, or insertions. For example, the present invention includes antigen-binding proteins which include an immunoglobulin light chain variant comprising an LCVR amino acid sequence set forth in Table 4 but having one or more of such mutations and/or an immunoglobulin heavy chain variant comprising an HCVR amino acid sequence set forth in Table 4 but having one or more of such mutations. In an embodiment of the invention, a variant anti-CoV-S antigen-binding protein includes an immunoglobulin light chain variant comprising LCDR1, LCDR2 and LCDR3 wherein one or more (e.g., 1 or 2 or 3) of such CDRs has one or more of such mutations (e.g., conservative substitutions) and/or an immunoglobulin heavy chain variant comprising HCDR1, HCDR2 and HCDR3 wherein one or more (e.g., 1 or 2 or 3) of such CDRs has one or more of such mutations (e.g., conservative substitutions). Substitutions can be in a CDR, framework, or constant region.

The invention further provides variant anti-CoV-S antigen-binding proteins, e.g., antibodies or antigen-binding fragments thereof, comprising one or more variant CDRs (e.g., any one or more of LCDR1, LCDR2, LCDR3, HCDR1, HCDR2 and/or HCDR3) that are set forth herein with at least 70%, 75%, 80%, 85%, 90%, 91%, 92%, 93%, 94%, 95%, 96%, 97%, 98%, 99%, or 99.9% sequence identity or similarity to, e.g., the heavy chain and light chain CDRs of Table 4.

Embodiments of the present invention also include variant antigen-binding proteins, e.g., anti-CoV-S antibodies and antigen-binding fragments thereof, that comprise immunoglobulin $V_{HS}$ and $V_{LS}$; or HCs and LCs, which comprise an amino acid sequence having 70% or more (e.g., 80%, 85%, 90%, 91%, 92%, 93%, 94%, 95%, 96%, 97%, 98%, 99%, or greater) overall amino acid sequence identity or similarity to the amino acid sequences of the corresponding $V_{HS}$, $V_{LS}$, HCs or LCs specifically set forth herein, but wherein the LCDR1, LCDR2, LCDR3, HCDR1, HCDR2 and HCDR3 of such immunoglobulins are not variants and comprise CDR amino acid sequence set forth in Table 4. Thus, in such embodiments, the CDRs within variant antigen-binding proteins are not, themselves, variants.

Conservatively modified variant anti-CoV-S antibodies and antigen-binding fragments thereof are also part of the present invention. A "conservatively modified variant" or a "conservative substitution" refers to a variant wherein there is one or more substitutions of amino acids in a polypeptide with other amino acids having similar characteristics (e.g. charge, side-chain size, hydrophobicity/hydrophilicity, backbone conformation and rigidity, etc.). Such changes can frequently be made without significantly disrupting the biological activity of the antibody or fragment. Those of skill in this art recognize that, in general, single amino acid substitutions in non-essential regions of a polypeptide do not substantially alter biological activity (see, e.g., Watson et al. (1987) Molecular Biology of the Gene, The Benjamin/Cummings Pub. Co., p. 224 ($4^{th}$ Ed.)). In addition, substitutions of structurally or functionally similar amino acids are less likely to significantly disrupt biological activity.

Examples of groups of amino acids that have side chains with similar chemical properties include 1) aliphatic side chains: glycine, alanine, valine, leucine and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartate and glutamate, and 7) sulfur-containing side chains: cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443 45.

Function-conservative variants of the anti-CoV-S antibodies and antigen-binding fragments thereof are also part of the present invention. Any of the variants of the anti-CoV-S antibodies and antigen-binding fragments thereof (as discussed herein) may be "function-conservative variants". Such function-conservative variants may, in some cases, also be characterized as conservatively modified variants. "Function-conservative variants," as used herein, refers to variants of the anti-CoV-S antibodies or antigen-binding fragments thereof in which one or more amino acid residues have been changed without significantly altering one or more functional properties of the antibody or fragment. In an embodiment of the invention, a function-conservative variant anti-CoV-S antibody or antigen-binding fragment thereof of the present invention comprises a variant amino acid sequence and exhibits one or more of the following functional properties:

Inhibits growth of coronavirus (e.g., SARS-CoV-2, SARS-CoV, and/or MERS-CoV) in ACE2- and/or TMPRSS2-expressing cells (e.g., Calu-3 cells);

Does not significantly bind to MDCK/Tet-on cells which do not express ACE2 and/or TMPRSS2;

Limits spread of coronavirus infection (e.g., by SARS-CoV-2, SARS-CoV, and/or MERS-CoV) of cells, e.g., Calu-3, in vitro; and/or Protects a mouse engineered to express the human TMPRSS2 and/or ACE2 protein from death caused by coronavirus infection (e.g., SARS-CoV-2, SARS-CoV, or MERS-CoV), for example, wherein the mice are infected with an otherwise lethal dose of the virus, optionally when combined with a second therapeutic agent.

Protects a mouse engineered to express the human TMPRSS2 and/or ACE2 protein from weight loss caused by coronavirus infection (e.g., SARS-CoV-2, SARS-CoV, or MERS-CoV), for example, wherein the mice are infected with a dose of the virus that would otherwise cause weight loss, optionally when combined with a second therapeutic agent.

A "neutralizing" or "antagonist" anti-CoV-S antigen-binding protein, e.g., antibody or antigen-binding fragment, refers to a molecule that inhibits an activity of CoV-S to any detectable degree, e.g., inhibits the ability of CoV-S to bind to a receptor such as ACE2, to be cleaved by a protease such as TMPRSS2, or to mediate viral entry into a host cell or viral reproduction in a host cell.

Table 4 refers to antigen-binding proteins, such as antibodies and antigen-binding fragments thereof, that comprise the heavy chain or $V_H$ (or a variant thereof) and light chain or $V_L$ (or a variant thereof) as set forth below; or that comprise a $V_H$ that comprises the CDRs thereof (HCDR1 (or a variant thereof), HCDR2 (or a variant thereof) and HCDR3 (or a variant thereof)) and a $V_L$ that comprises the CDRs thereof (LCDR1 (or a variant thereof), LCDR2 (or a variant thereof) and LCDR3 (or a variant thereof)), e.g., wherein the immunoglobulin chains, variable regions and/or CDRs comprise the specific amino acid sequences described below.

The antibodies described herein also include embodiments wherein the $V_H$ is fused to a wild-type IgG4 (e.g., wherein residue 108 is S) or to IgG4 variants (e.g., wherein residue 108 is P).

Antibodies and antigen-binding fragments of the present invention comprise immunoglobulin chains including the amino acid sequences set forth herein as well as cellular and in vitro post-translational modifications to the antibody. For example, the present invention includes antibodies and antigen-binding fragments thereof that specifically bind to CoV-S comprising heavy and/or light chain amino acid sequences set forth herein (e.g., HCDR1, HCDR2, HCDR3, LCDR1, LCDR2 and/or LCDR3) as well as antibodies and fragments wherein one or more amino acid residues is glycosylated, one or more Asn residues is deamidated, one or more residues (e.g., Met, Trp and/or His) is oxidized, the N-terminal Gln is pyroglutamate (pyroE) and/or the C-terminal Lysine is missing. The amino acid and nucleotide sequences of exemplary anti-SARS-CoV-2-Spike protein (SARS-CoV-2-S) antibodies are shown in the Table of Exemplary Sequences (Table 1), below.

TABLE 1

Table of Exemplary Sequences

| Antibody Designation | Component Part | Sequence | SEQ ID NO |
|---|---|---|---|
| mAb14256 | | Amino Acids | |
| | HCVR | QVQLQESGPGLVKPSETLSLTCTVSGGSISSHYW SWIRQPPGKGLEWIGYIYYSGSSNYNPSLKSRVT ISVDTSKNQFSLKLNSVTAADTAVYYCARHYDIL TGFDWFDPWGQGTLVTVSS | 887 |
| | HCDR1 | GGSISSHY | 889 |
| | HCDR2 | IYYSGSS | 891 |
| | HCDR3 | ARHYDILTGFDWFDP | 893 |
| | LCVR | QSVLTQPPSVSGAPGQRVTISCTGSSSNIGTHYD VHWYQQLPGTAPKLLIYGNSNRPSGVPDRFSGSK SGTSASLAITGLQAEDEADYYCQSFDNSLTAPYV FGTGTKVTVL | 895 |
| | LCDR1 | SSNIGTHYD | 897 |
| | LCDR2 | GNS | 164 |
| | LCDR3 | QSFDNSLTAPYV | 899 |
| | HC | QVQLQESGPGLVKPSETLSLTCTVSGGSISSHYW SWIRQPPGKGLEWIGYIYYSGSSNYNPSLKSRVT ISVDTSKNQFSLKLNSVTAADTAVYYCARHYDIL TGFDWFDPWGQGTLVTVSSASTKGPSVFPLAPSS KSTSGGTAALGCLVKDYFPEPVTVSWNSGALTSG VHTFPAVLQSSGLYSLSSVVTVPSSSLGTQTYIC NVNHKPSNTKVDKKVEPKSCDKTHTCPPCPAPEL LGGPSVFLFPPKPKDTLMISRTPEVTCVVVDVSH EDPEVKFNWYVDGVEVHNAKTKPREEQYNSTYRV VSVLTVLHQDWLNGKEYKCKVSNKALPAPIEKTI SKAKGQPREPQVYTLPPSRDELTKNQVSLTCLVK GFYPSDIAVEWESNGQPENNYKTTPPVLDSDGSF FLYSKLTVDKSRWQQGNVFSCSVMHEALHNHYTQ KSLSLSPGK | 901 |
| | LC | QSVLTQPPSVSGAPGQRVTISCTGSSSNIGTHYD VHWYQQLPGTAPKLLIYGNSNRPSGVPDRFSGSK SGTSASLAITGLQAEDEADYYCQSFDNSLTAPYV FGTGTKVTVLGQPKAAPSVTLFPPSSEELQANKA TLVCLISDFYPGAVTVAWKADSSPVKAGVETTTP SKQSNNKYAASSYLSLTPEQWKSHRSYSCQVTHE GSTVEKTVAPTECS | 903 |
| | | Nucleic Acids | |
| | HCVR | caggtgcagctgcaggagtcgggcccaggactgg tgaagccttcggagaccctgtccctcacctgcac tgtctctggtggctccatcagtagtcactactgg agctggatccggcagccccagggaagggactgg aatggattgggtatatttattacagcgggagctc caactacaaccctccctcaagagtcgagtcacc atatcagtagacacgtccaagaaccagttctccc tgaaactgaattctgtgaccgccgcagacacggc cgtgtattactgtgcgagacattacgatattttg actggttttgactggttcgacccctggggccagg gaaccctggtcaccgtctcctca | 886 |
| | HCDR1 | ggtggctccatcagtagtcactac | 888 |
| | HCDR2 | atttattacagcgggagctcc | 890 |
| | HCDR3 | gcgagacattacgatattttgactggttttgact ggttcgacccc | 892 |
| | LCVR | cagtctgtgctgacgcagccgccctcagtgtcag gggcccagggcagagggtcaccatctcctgcac tgggagcagttccaacatcgggacacattatgat gtacactggtaccaacaacttccaggaacagccc ccaaactcctcatctatggtaacagcaatcggcc ctcaggggtccctgaccgattctctggctccaag tctggcacctcagcctccctggccatcactgggc tccaggctgaggatgaggctgattattactgcca gtcctttgacaacagcctgactgcccccttatgtc ttcggaactgggaccaaggtcaccgtccta | 894 |
| | LCDR1 | agttccaacatcgggacacattatgat | 896 |
| | LCDR2 | ggtaacagc | 163 |
| | LCDR3 | cagtcctttgacaacagcctgactgcccccttatg tc | 898 |
| | HC | caggtgcagctgcaggagtcgggcccaggactgg tgaagccttcggagaccctgtccctcacctgcac tgtctctggtggctccatcagtagtcactactgg agctggatccggcagccccagggaagggactgg aatggattgggtatatttattacagcgggagctc caactacaaccctccctcaagagtcgagtcacc atatcagtagacacgtccaagaaccagttctccc | 900 |

TABLE 1-continued

Table of Exemplary Sequences

| Antibody Designation | Component Part | Sequence | SEQ ID NO |
|---|---|---|---|
| | | tgaaactgaattctgtgaccgccgcagacacggc<br>cgtgtattactgtgcgagacattacgatattttg<br>actggttttgactggttcgacccctggggccagg<br>gaaccctggtcaccgtctcctcagcctccaccaa<br>gggcccatcggtcttccccctggcaccctcctcc<br>aagagcacctctgggggcacagcggccctgggct<br>gcctggtcaaggactacttccccgaaccggtgac<br>ggtgtcgtggaactcaggcgccctgaccagcggc<br>gtgcacaccttcccggctgtcctacagtcctcag<br>gactctactccctcagcagcgtggtgaccgtgcc<br>ctccagcagcttgggcacccagacctacatctgc<br>aacgtgaatcacaagcccagcaacaccaaggtgg<br>acaagaaagttgagcccaaatcttgtgacaaaac<br>tcacacatgcccaccgtgcccagcacctgaactc<br>ctgggggaccgtcagtcttcctcttccccccaa<br>aacccaaggacaccctcatgatctcccggaccc<br>tgaggtcacatgcgtggtggtggacgtgagccac<br>gaagaccctgaggtcaagttcaactggtacgtgg<br>acggcgtggaggtgcataatgccaagacaaagcc<br>gcgggaggagcagtacaacagcacgtaccgtgtg<br>gtcagcgtcctcaccgtcctgcaccaggactggc<br>tgaatggcaaggagtacaagtgcaaggtctccaa<br>caaagccctcccagcccccatcgagaaaaccatc<br>tccaaagccaaagggcagccccgagaaccacagg<br>tgtacaccctgcccccatcccgggatgagctgac<br>caagaaccaggtcagcctgacctgcctggtcaaa<br>ggcttctatcccagcgacatcgccgtggagtggg<br>agagcaatgggcagccggagaacaactacaagac<br>cacgcctcccgtgctggactccgacggctccttc<br>ttcctctacagcaagctcaccgtggacaagagca<br>ggtggcagcaggggaacgtcttctcatgctccgt<br>gatgcatgaggctctgcacaaccactacacgcag<br>aagtccctctccctgtctccgggtaaatga | |
| | LC | cagtctgtgctgacgcagccgccctcagtgtcag<br>gggcccagggcagagggtcaccatctcctgcac<br>tgggagcagttccaacatcgggacacattatgat<br>gtacactggtaccaacaacttccaggaacagccc<br>ccaaactcctcatctatggtaacagcaatcggcc<br>ctcaggggtccctgaccgattctctggctccaag<br>tctggcacctcagcctccctggccatcactggc<br>tccaggctgaggatgaggctgattattactgcca<br>gtcctttgacaacagcctgactgcccttatgtc<br>ttcggaactgggaccaaggtcaccgtcctaggcc<br>agcccaaggccgccccctccgtgaccctgttccc<br>ccctcctccgaggagctgcaggccaacaaggcc<br>accctggtgtgcctgatctccgacttctacccg<br>gcgccgtgaccgtggcctggaaggccgactcctc<br>ccccgtgaaggccggcgtggagaccaccacccc<br>tccaagcagtccaacaacaagtacgccgcctcct<br>cctacctgtccctgaccccgagcagtggaagtc<br>ccaccggtcctactcctgccaggtgacccacgag<br>ggctccaccgtggagaagaccgtggcccccaccg<br>agtgctcctga | 902 |
| mAb14315 | | Amino Acids | |
| | HCVR | QVQLVQSGAEVKKPGSSVKVSCKASGDTFSTYAI<br>NWVRQAPGQGLEWMGRFIHIFGTANYAQKFQGRV<br>TITADESTSTAYMELRSLRSEDTAVYYCARDGVD<br>YGDYRPDYWGQGTLVTVSS | 212 |
| | HCDR1 | GDTFSTYA | 214 |
| | HCDR2 | FIHIFGTA | 216 |
| | HCDR3 | ARDGVDYGDYRPDY | 218 |
| | LCVR | EIVLTQSPGTLSLSPGERATLSCRASQSVSSNYL<br>AWYQQKPGQAPRLLIYGASSRATGIPERFSGSGS<br>GTDFTLTISRLEPEDFAVYYCQQYGSSLYTFGQG<br>TKLEIK | 220 |
| | LCDR1 | QSVSSNY | 222 |
| | LCDR2 | GAS | 126 |
| | LCDR3 | QQYGSSLYT | 224 |
| | HC | QVQLVQSGAEVKKPGSSVKVSCKASGDTFSTYAI<br>NWVRQAPGQGLEWMGRFIHIFGTANYAQKFQGRV<br>TITADESTSTAYMELRSLRSEDTAVYYCARDGVD<br>YGDYRPDYWGQGTLVTVSSASTKGPSVFPLAPSS<br>KSTSGGTAALGCLVKDYFPEPVTVSWNSGALTSG | 226 |

TABLE 1-continued

Table of Exemplary Sequences

| Antibody Designation | Component Part | Sequence | SEQ ID NO |
|---|---|---|---|
| | | VHTFPAVLQSSGLYSLSSVVTVPSSSLGTQTYIC NVNHKPSNTKVDKKVEPKSCDKTHTCPPCPAPEL LGGPSVFLFPPKPKDTLMISRTPEVTCVVVDVSH EDPEVKFNWYVDGVEVHNAKTKPREEQYNSTYRV VSVLTVLHQDWLNGKEYKCKVSNKALPAPIEKTI SKAKGQPREPQVYTLPPSRDELTKNQVSLTCLVK GFYPSDIAVEWESNGQPENNYKTTPPVLDSDGSF FLYSKLTVDKSRWQQGNVFSCSVMHEALHNHYTQ KSLSLSPGK | |
| | LC | EIVLTQSPGTLSLSPGERATLSCRASQSVSSNYL AWYQQKPGQAPRLLIYGASSRATGIPERFSGSGS GTDFTLTISRLEPEDFAVYYCQQYGSSLYTFGQG TKLEIKRTVAAPSVFIFPPSDEQLKSGTASVVCL LNNFYPREAKVQWKVDNALQSGNSQESVTEQDSK DSTYSLSSTLTLSKADYEKHKVYACEVTHQGLSS PVTKSFNRGEC | 228 |

Nucleic Acids

| | | | |
|---|---|---|---|
| | HCVR | caggtgcagctggtgcagtctggggctgaggtga agaagcctgggtcctcggtgaaggtctcctgcaa ggcttctggagacaccttcagcacctatgctatc aactgggtgcgacaggcccctggacaagggcttg agtggatgggaagattcatccatatctttggtac agcaaactacgcacagaagttccagggcagagtc accattaccgcggacgaatccacgagcacagcct acatggagctgcgcagcctgagatctgaggacac ggccgtttattactgcgcgagagacggagtagac tacggtgactaccgacctgactactggggccagg gaaccctggtcaccgtctcctca | 211 |
| | HCDR1 | ggagacaccttcagcacctatgct | 213 |
| | HCDR2 | ttcatccatatctttggtacagca | 215 |
| | HCDR3 | gcgagagacggagtagactacggtgactaccgac ctgactac | 217 |
| | LCVR | gaaattgtgttgacgcagtctccaggcaccctgt ctttgtctccaggggaaagagccaccctctcctg cagggccagtcagagtgttagtagcaactactta gcctggtaccagcagaaacctggccaggctccca gactcctcatctatggtgcatccagcagggccac tggcatcccagagaggttcagtggcagtgggtct gggacagacttcactctcaccatcagcagactgg agcctgaagattttgcagtatattactgtcagca gtatggtagctcgctgtacacttttggccagggg accaagctggagatcaaa | 219 |
| | LCDR1 | cagagtgttagtagcaactac | 221 |
| | LCDR2 | ggtgcatcc | 125 |
| | LCDR3 | cagcagtatggtagctcgctgtacact | 223 |
| | HC | caggtgcagctggtgcagtctggggctgaggtga agaagcctgggtcctcggtgaaggtctcctgcaa ggcttctggagacaccttcagcacctatgctatc aactgggtgcgacaggcccctggacaagggcttg agtggatgggaagattcatccatatctttggtac agcaaactacgcacagaagttccagggcagagtc accattaccgcggacgaatccacgagcacagcct acatggagctgcgcagcctgagatctgaggacac ggccgtttattactgcgcgagagacggagtagac tacggtgactaccgacctgactactggggccagg gaaccctggtcaccgtctcctcagcctccaccaa gggcccatcggtcttccccctggcaccctcctcc aagagcacctctgggggcacagcggccctgggct gcctggtcaaggactacttccccgaaccggtgac ggtgtcgtggaactcaggcgccctgaccagcggc gtgcacaccttcccggctgtcctacagtcctcag gactctactccctcagcagcgtggtgaccgtgcc ctccagcagcttgggcacccagacctacatctgc aacgtgaatcacaagcccagcaacaccaaggtgg acaagaaagttgagcccaaatcttgtgacaaaac tcacacatgcccaccgtgcccagcacctgaactc ctggggggaccgtcagtcttcctcttccccccaa aacccaaggacaccctcatgatctcccggacccc tgaggtcacatgcgtggtggtggacgtgagccac gaagaccctgaggtcaagttcaactggtacgtgg acggcgtggaggtgcataatgccaagacaaagcc gcgggaggagcagtacaacagcacgtaccgtgtg gtcagcgtcctcaccgtcctgcaccaggactggc tgaatggcaaggagtacaagtgcaaggtctccaa | 225 |

TABLE 1-continued

Table of Exemplary Sequences

| Antibody Designation | Component Part | Sequence | SEQ ID NO |
|---|---|---|---|
| | | caaagccctcccagcccccatcgagaaaaccatc tccaaagccaaagggcagccccgagaaccacagg tgtacaccctgcccccatcccgggatgagctgac caagaaccaggtcagcctgacctgcctggtcaaa ggcttctatcccagcgacatcgccgtggagtggg agagcaatgggcagccggagaacaactacaagac cacgcctcccgtgctggactccgacggctccttc ttcctctacagcaagctcaccgtggacaagagca ggtggcagcaggggaacgtcttctcatgctccgt gatgcatgaggctctgcacaaccactacacgcag aagtccctctccctgtctccgggtaaatga | |
| | LC | gaaattgtgttgacgcagtctccaggcaccctgt ctttgtctccaggggaaagagccaccctctcctg cagggccagtcagagtgttagtagcaactactta gcctggtaccagcagaaacctggccaggctccca gactcctcatctatggtgcatccagcagggccac tggcatcccagagaggttcagtggcagtgggtct gggacagacttcactctcaccatcagcagactgg agcctgaagattttgcagtatattactgtcagca gtatggtagctcgctgtacacttttggccagggg accaagctggagatcaaacgaactgtggctgcac catctgtcttcatcttcccgccatctgatgagca gttgaaatctggaactgcctctgttgtgtgcctg ctgaataacttctatcccagagaggccaaagtac agtggaaggtggataacgcccttccaatcgggtaa ctcccaggagagtgtcacagagcaggacagcaag gacagcacctacagcctcagcagcaccctgacgc tgagcaaagcagactacgagaaacacaaagtcta cgcctgcgaagtcacccatcagggcctgagctcg cccgtcacaaagagcttcaacaggggagagtgtt ag | 227 |
| mAb15151 | | Amino Acids | |
| | HCVR | QVQLVESGGGVVQPGRSLRLSCAASGFVFNSYGM HWVRQAPGKGLEWVAVLWYEGSKNYYADSVKGRF TISRDNSKNTLYLQMNSLRAEDTAVYYCARHGSG SFFGYYLDYWGQGTLVTVSS | 270 |
| | HCDR1 | GFVFNSYG | 272 |
| | HCDR2 | LWYEGSKN | 274 |
| | HCDR3 | ARHGSGSFFGYYLDY | 276 |
| | LCVR | DIQMTQSPSSLSASVGDRVTITCRASHNINDFLN WYQQKPGKAPRLLIYAASSLQSGVPSRFSGSGSG TDFTLTISSLQPEDFATYYCQESYTTPPTFGQGT KLEIK | 278 |
| | LCDR1 | HNINDF | 280 |
| | LCDR2 | AAS | 106 |
| | LCDR3 | QESYTTPPT | 282 |
| | HC | QVQLVESGGGVVQPGRSLRLSCAASGFVFNSYGM HWVRQAPGKGLEWVAVLWYEGSKNYYADSVKGRF TISRDNSKNTLYLQMNSLRAEDTAVYYCARHGSG SFFGYYLDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYI CNVNHKPSNTKVDKKVEPKSCDKTHTCPPCPAPE LLGGPSVFLFPPKPKDTLMISRTPEVTCVVVDVS HEDPEVKFNWYVDGVEVHNAKTKPREEQYNSTYR VVSVLTVLHQDWLNGKEYKCKVSNKALPAPIEKT ISKAKGQPREPQVYTLPPSRDELTKNQVSLTCLV KGFYPSDIAVEWESNGQPENNYKTTPPVLDSDGS FFLYSKLTVDKSRWQQGNVFSCSVMHEALHNHYT QKSLSLSPGK | 284 |
| | LC | DIQMTQSPSSLSASVGDRVTITCRASHNINDFLN WYQQKPGKAPRLLIYAASSLQSGVPSRFSGSGSG TDFTLTISSLQPEDFATYYCQESYTTPPTFGQGT KLEIKRTVAAPSVFIFPPSDEQLKSGTASVVCLL NNFYPREAKVQWKVDNALQSGNSQESVTEQDSKD STYSLSSTLTLSKADYEKHKVYACEVTHQGLSSP VTKSFNRGEC | 286 |
| | | Nucleic Acids | |
| | HCVR | caggtgcagctggtggagtctggggaggcgtgg tccagcctggggaggtccctgagactctcctgtgc agcgtctggtttcgtcttcaatagctatggcatg cactgggtccgccaggctccaggcaaggggctgg | 269 |

TABLE 1-continued

Table of Exemplary Sequences

| Antibody Designation | Component Part | Sequence | SEQ ID NO |
|---|---|---|---|
| | | agtgggtggcagttctatggtatgaaggaagtaa aaattactatgcagactccgtgaagggccgattc accatctccagagacaattccaagaacacactgt atctgcaaatgaacagcctgagagccgaggacac ggctgtgtattactgtgcgaggcatggttcaggg agtttttttgggtactacttggactactggggcc agggaaccctggtcaccgtctcctca | |
| | HCDR1 | ggtttcgtcttcaatagctatggc | 271 |
| | HCDR2 | ctatggtatgaaggaagtaaaaat | 273 |
| | HCDR3 | gcgaggcatggttcagggagttttttgggtact acttggactac | 275 |
| | LCVR | gacatccagatgacccagtctccatcctccctgt ctgcatctgtaggagacagagtcaecatcacttg ccgggcaagtcacaacattaatgacttttaaat tggtatcagcagaaaccagggaaagcccctaggc tcctgatctatgctgcatccagtttgcaaagtgg ggtcccatcaaggttcagtggcagtggatctggg acagatttcactctcaccatcagcagtctacaac ctgaagattttgcaacttactactgtcaagagag ttacactacccctccgacttttggccaggggacc aagctggagatcaaa | 277 |
| | LCDR1 | cacaacattaatgactttt | 279 |
| | LCDR2 | gctgcatcc | 105 |
| | LCDR3 | caagagagttacactacccctccgact | 281 |
| | HC | caggtgcagctggtggagtctggggga ggcgtgg tccagcctgggaggtccctgagactctcctgtgc agcgtctggtttcgtcttcaatagctatggcatg cactgggtccgccaggctccaggcaaggggctgg agtgggtggcagttctatggtatgaaggaagtaa aaattactatgcagactccgtgaagggccgattc accatctccagagacaattccaagaacacactgt atctgcaaatgaacagcctgagagccgaggacac ggctgtgtattactgtgcgaggcatggttcaggg agtttttttgggtactacttggactactggggcc agggaaccctggtcaccgtctcctcagcctccac caagggcccatcggtcttccccctggcaccctcc tccaagagcacctctggggg cacagcggccctgg gctgcctggtcaaggactacttccccgaaccggt gacggtgtcgtggaactcaggcgccctgaccagc ggcgtgcacaccttcccggctgtcctacagtcct caggactctactccctcagcagcgtggtgaccgt gccctccagcagcttgggcacccagacctacatc tgcaacgtgaatcacaagcccagcaacaccaagg tggacaagaaagttgagcccaaatcttgtgacaa aactcacacatgcccaccgtgcccagcacctgaa ctcctggggggaccgtcagtcttcctcttccccc caaaacccaaggacaccctcatgatctcccggac ccctgaggtcacatgcgtggtggtggacgtgagc cacgaagaccctgaggtcaagttcaactggtacg tggacggcgtggaggtgcataatgccaagacaaa gccgcgggaggagcagtacaacagcacgtaccgt gtggtcagcgtcctcaccgtcctgcaccaggact ggctgaatggcaaggagtacaagtgcaaggtctc caacaaagcccctcccagccccatcgagaaaacc atctccaaagccaaagggcagccccgagaaccac aggtgtacaccctgcccccatcccgggatgagct gaccaagaaccaggtcagcctgacctgcctggtc aaaggcttctatcccagcgacatcgccgtggagt gggagagcaatgggcagccggagaacaactacaa gaccacgcctcccgtgctggactccgacggctcc ttcttcctctacagcaagctcaccgtggacaaga gcaggtggcagcaggggaacgtcttctcatgctc cgtgatgcatgaggctctgcacaaccactacacg cagaagtccctctccctgtctccgggtaaatga | 283 |
| | LC | gacatccagatgacccagtctccatcctccctgt ctgcatctgtaggagacagagtcaecatcacttg ccgggcaagtcacaacattaatgacttttaaat tggtatcagcagaaaccagggaaagcccctaggc tcctgatctatgctgcatccagtttgcaaagtgg ggtcccatcaaggttcagtggcagtggatctggg acagatttcactctcaccatcagcagtctacaac ctgaagattttgcaacttactactgtcaagagag ttacactacccctccgacttttggccaggggacc aagctggagatcaaacgaactgtggctgcaccat ctgtcttcatcttcccgccatctgatgagcagtt | 285 |

TABLE 1-continued

Table of Exemplary Sequences

| Antibody Designation | Component Part | Sequence | SEQ ID NO |
|---|---|---|---|
| | | gaaatctggaactgcctctgttgtgtgcctgctg<br>aataacttctatcccagagaggccaaagtacagt<br>ggaaggtggataacgccctccaatcgggtaactc<br>ccaggagagtgtcacagagcaggacagcaaggac<br>agcacctacagcctcagcagcaccctgacgctga<br>gcaaagcagactacgagaaacacaaagtctacgc<br>ctgcgaagtcacccatcagggcctgagctcgccc<br>gtcacaaagagcttcaacaggggagagtgttag | |
| mAb14284 | | Amino Acids | |
| | HCVR | QITLKESGPTLVKPTQTLTLTCTFSGFSFSTSGV<br>GVGWIRQPPGKTLEWLALIYWDDDKRYSPSLKSR<br>LTITKDTSKNQVVLTMTNMDPVDTATYFCAHHGI<br>PTIFGYWGQGALVTVSS | 493 |
| | HCDR1 | GFSFSTSGVG | 495 |
| | HCDR2 | IYWDDDK | 497 |
| | HCDR3 | AHHGIPTIFGY | 499 |
| | LCVR | QSALTQPASVSGSPGQSITISCTGTSSDLGVFNY<br>VSWYQQHPGKAPKLMIYEVTNRPSGVSNRFSGSK<br>SGNTASLTISGLQAEDEADYYCSSYTTSSTVFGG<br>GTKLTVL | 501 |
| | LCDR1 | SSDLGVFNY | 503 |
| | LCDR2 | EVT | 505 |
| | LCDR3 | SSYTTSSTV | 507 |
| | HC | QITLKESGPTLVKPTQTLTLTCTFSGFSFSTSGV<br>GVGWIRQPPGKTLEWLALIYWDDDKRYSPSLKSR<br>LTITKDTSKNQVVLTMTNMDPVDTATYFCAHHGI<br>PTIFGYWGQGALVTVSSASTKGPSVFPLAPSSKS<br>TSGGTAALGCLVKDYFPEPVTVSWNSGALTSGVH<br>TFPAVLQSSGLYSLSSVVTVPSSSLGTQTYICNV<br>NHKPSNTKVDKKVEPKSCDKTHTCPPCPAPELLG<br>GPSVFLFPPKPKDTLMISRTPEVTCVVVDVSHED<br>PEVKFNWYVDGVEVHNAKTKPREEQYNSTYRVVS<br>VLTVLHQDWLNGKEYKCKVSNKALPAPIEKTISK<br>AKGQPREPQVYTLPPSRDELTKNQVSLTCLVKGF<br>YPSDIAVEWESNGQPENNYKTTPPVLDSDGSFFL<br>YSKLTVDKSRWQQGNVFSCSVMHEALHNHYTQKS<br>LSLSPGK | 509 |
| | LC | QSALTQPASVSGSPGQSITISCTGTSSDLGVFNY<br>VSWYQQHPGKAPKLMIYEVTNRPSGVSNRFSGSK<br>SGNTASLTISGLQAEDEADYYCSSYTTSSTVFGG<br>GTKLTVLGQPKAAPSVTLFPPSSEELQANKATLV<br>CLISDFYPGAVTVAWKADSSPVKAGVETTTPSKQ<br>SNNKYAASSYLSLTPEQWKSHRSYSCQVTHEGST<br>VEKTVAPTECS | 511 |
| | | Nucleic Acids | |
| | HCVR | cagatcaccttgaaggagtctggtcctacgctgg<br>tgaaacccacacagaccctcacgctgacctgcac<br>cttctctgggttctcatttagcacttctggagtg<br>ggtgtgggctggatccgtcagcccccaggaaaga<br>ccctggagtggcttgcactcatttattgggatga<br>tgataagcgctacagcccatctctgaagagcagg<br>ctcaecattaccaaggacacctccaaaaaccagg<br>tggtccttacaatgaccaacatggaccctgtgga<br>cactgccacatatttctgtgcacaccatggaata<br>cctacgatctttggctactggggccagggagccc<br>tggtcaccgtctcctca | 492 |
| | HCDR1 | gggttctcatttagcacttctggagtgggt | 494 |
| | HCDR2 | atttattgggatgatgataag | 496 |
| | HCDR3 | gcacaccatggaatacctacgatctttggctac | 498 |
| | LCVR | cagtctgccctgactcagcctgcctccgtgtctg<br>ggtctcctggacagtcgatcaccatctcctgcac<br>tggaaccagcagtgaccttggtgtttttaactat<br>gtctcctggtaccaacagcacccaggcaaagccc<br>ccaaactcatgatttatgaggtcactaatcgcc<br>ctcaggggtttctaatcgcttctctggctccaag<br>tctggcaacacggcctcctgaccatctctgggc<br>tccaggctgaggacgaggctgattattattgcag<br>ctcatatacaaccagcagcactgttttcggcgga<br>gggaccaagctgaccgtccta | 500 |

TABLE 1-continued

Table of Exemplary Sequences

| Antibody Designation | Component Part | Sequence | SEQ ID NO |
|---|---|---|---|
| | LCDR1 | agcagtgaccttggtgtttttaactat | 502 |
| | LCDR2 | gaggtcact | 504 |
| | LCDR3 | agctcatatacaaccagcagcactgtt | 506 |
| | HC | cagatcaccttgaaggagtctggtcctacgctgg tgaaacccacacagaccctcacgctgacctgcac cttctctgggttctcatttagcacttctggagtg ggtgtgggctggatccgtcagcccccaggaaaga ccctggagtggcttgcactcatttattgggatga tgataagcgctacagccatctctgaagagcagg ctcaccattaccaaggacacctccaaaaaccagg tggtccttacaatgaccaacatggaccctgtgga cactgccacatatttctgtgcacaccatggaata cctacgatctttggctactggggccagggagccc tggtcaccgtctcctcagcctccaccaagggccc atcggtcttccccctggcaccctcctccaagagc acctctgggggcacagcggccctgggctgcctgg tcaaggactacttccccgaaccggtgacggtgtc gtggaactcaggcgccctgaccagcggcgtgcac accttcccggctgtcctacagtcctcaggactct actccctcagcagcgtggtgaccgtgccctccag cagcttgggcacccagacctacatctgcaacgtg aatcacaagcccagcaacaccaaggtggacaaga aagttgagcccaaatcttgtgacaaaactcacac atgcccaccgtgcccagcacctgaactcctgggg ggaccgtcagtcttcctcttccccccaaaaccca aggacaccctcatgatctcccggacccctgaggt cacatgcgtggtggtggacgtgagccacgaagac cctgaggtcaagttcaactggtacgtggacggcg tggaggtgcataatgccaagacaaagccgcggga ggagcagtacaacagcacgtaccgtgtggtcagc gtcctcaccgtcctgcaccaggactggctgaatg gcaaggagtacaagtgcaaggtctccaacaaagc cctcccagcccccatcgagaaaaccatctccaaa gccaaagggcagccccgagaaccacaggtgtaca ccctgcccccatcccgggatgagctgaccaagaa ccaggtcagcctgacctgcctggtcaaaggcttc tatcccagcgacatcgccgtggagtgggagagca atgggcagccggagaacaactacaagaccacgcc tcccgtgctggactccgacggctccttcttcctc tacagcaagctcaccgtggacaagagcaggtggc agcaggggaacgtcttctcatgctccgtgatgca tgaggctctgcacaaccactacacgcagaagtcc ctctccctgtctccgggtaaatga | 508 |
| | LC | cagtctgccctgactcagcctgcctccgtgtctg ggtctcctggacagtcgatcaccatctcctgcac tggaaccagcagtgaccttggtgtttttaactat gtctcctggtaccaacagcacccaggcaaagccc ccaaactcatgatttatgaggtcactaatcggcc ctcaggggtttctaatcgcttctctggctccaag tctggcaacacggcctcctgaccatctctgggc tccaggctgaggacgaggctgattattattgcag ctcatatacaaccagcagcactgttttcggcgga gggaccaagctgaccgtcctaggccagcccaagg ccgccccctccgtgaccctgttccccccctcctc cgaggagctgcaggccaacaaggccaccctggtg tgcctgatctccgacttctaccccggcgccgtga ccgtggcctggaaggccgactcctcccccgtgaa ggccggcgtggagaccaccacccccctccaagcag tccaacaacaagtacgccgcctcctcctacctgt ccctgaccccgagcagtggaagtccaccggtc ctactcctgccaggtgacccacgagggctccacc gtggagaagaccgtggcccccaccgagtgctcct ga | 510 |
| mAb15160 | | Amino Acids | |
| | HCVR | EVQLVESGGGLVQPGGSLRLSCSASGFTFSRYAM YWVRQAPGKGLEYVSAISSDGGSTYDADSVKGRF TISRANSKNTLYLQMSSLRAEDTAVYYCVKGLRE LLYYYGMDVWGQGTTVTVSS | 362 |

TABLE 1-continued

Table of Exemplary Sequences

| Antibody Designation | Component Part | Sequence | SEQ ID NO |
|---|---|---|---|
| | HCDR1 | GFTFSRYA | 364 |
| | HCDR2 | ISSDGGST | 366 |
| | HCDR3 | VKGLRELLYYYYGMDV | 368 |
| | LCVR | DIQMTQSPSSLSASVGDRVTITCRAGQSISSFLN WYQQKPGKAPKLLIYAASSLQSGVPSRFSGSGSG TDFTLTISSLQPEDFATYYCQQSYITPFTFGPGT KVDIK | 370 |
| | LCDR1 | QSISSF | 372 |
| | LCDR2 | AAS | 106 |
| | LCDR3 | QQSYITPFT | 374 |
| | HC | EVQLVESGGGLVQPGGSLRLSCSASGFTFSRYAM YWVRQAPGKGLEYVSAISSDGGSTYDADSVKGRF TISRANSKNTLYLQMSSLRAEDTAVYYCVKGLRE LLYYYYGMDVWGQGTTVTVSSASTKGPSVFPLAP SSKSTSGGTAALGCLVKDYFPEPVTVSWNSGALT SGVHTFPAVLQSSGLYSLSSVVTVPSSSLGTQTY ICNVNHKPSNTKVDKKVEPKSCDKTHTCPPCPAP ELLGGPSVFLFPPKPKDTLMISRTPEVTCVVVDV SHEDPEVKFNWYVDGVEVHNAKTKPREEQYNSTY RVVSVLTVLHQDWLNGKEYKCKVSNKALPAPIEK TISKAKGQPREPQVYTLPPSRDELTKNQVSLTCL VKGFYPSDIAVEWESNGQPENNYKTTPPVLDSDG SFFLYSKLTVDKSRWQQGNVFSCSVMHEALHNHY TQKSLSLSPGK | 376 |
| | LC | DIQMTQSPSSLSASVGDRVTITCRAGQSISSFLN WYQQKPGKAPKLLIYAASSLQSGVPSRFSGSGSG TDFTLTISSLQPEDFATYYCQQSYITPFTFGPGT KVDIKRTVAAPSVFIFPPSDEQLKSGTASVVCLL NNFYPREAKVQWKVDNALQSGNSQESVTEQDSKD STYSLSSTLTLSKADYEKHKVYACEVTHQGLSSP VTKSFNRGEC | 378 |

Nucleic Acids

| | HCVR | gaggtgcagctggtggagtctgggggaggcttgg tccagcctggggggtccctgagactctcctgttc agcctctggattcaccttcagtaggtacgctatg tactgggtccgccaggctccagggaagggactgg aatatgtttcagctattagtagtgatgggggtag cacatacgacgcagactccgtgaagggcagattc accatctccagagccaattccaagaacacgctgt accttcaaatgagcagtctgagagctgaggacac ggctgtgtattattgtgtgaaaggtctgcgggag ttactctactactattacggaatggacgtctggg gccaagggactacggtcaccgtctcctca | 361 |
|---|---|---|---|
| | HCDR1 | ggattcaccttcagtaggtacgct | 363 |
| | HCDR2 | attagtagtgatgggggtagcaca | 365 |
| | HCDR3 | gtgaaaggtctgcgggagttactctactactatt acggaatggacgtc | 367 |
| | LCVR | gacatccagatgacccagtctccatcctccctgt ctgcatctgtaggagacagagtcaccatcacttg ccgggcaggtcagagcattagcagcttttttaaat tggtatcagcagaagccagggaaagcccctaagc tcctgatctatgctgcatccagtttgcaaagtgg ggtcccatcaaggttcagtggcagtggatctggg acagatttcactctcaccatcagcagtctccaac ctgaagatttttgcaacttactactgtcaacagag ttacattacccccttcactttcggccctgggacc aaggtggatatcaaa | 369 |
| | LCDR1 | cagagcattagcagcttt | 371 |
| | LCDR2 | gctgcatcc | 105 |
| | LCDR3 | caacagagttacattacccccttcact | 373 |
| | HC | gaggtgcagctggtggagtctgggggaggcttgg tccagcctggggggtccctgagactctcctgttc agcctctggattcaccttcagtaggtacgctatg tactgggtccgccaggctccagggaagggactgg aatatgtttcagctattagtagtgatgggggtag cacatacgacgcagactccgtgaagggcagattc accatctccagagccaattccaagaacacgctgt accttcaaatgagcagtctgagagctgaggacac ggctgtgtattattgtgtgaaaggtctgcgggag ttactctactactattacggaatggacgtctggg gccaagggactacggtcaccgtctcctcagcctc caccaagggcccatcggtcttccccctggcaccc tcctccaagagcacctctgggggcacagcggccc tgggctgcctggtcaaggactacttccccgaacc | 375 |

TABLE 1-continued

Table of Exemplary Sequences

| Antibody Designation | Component Part | Sequence | SEQ ID NO |
|---|---|---|---|
| | | ggtgacggtgtcgtggaactcaggcgccctgacc<br>agcggcgtgcacaccttcccggctgtcctacagt<br>cctcaggactctactccctcagcagcgtggtgac<br>cgtgccctccagcagcttgggcacccagacctac<br>atctgcaacgtgaatcacaagcccagcaacacca<br>aggtggacaagaaagttgagcccaaatcttgtga<br>caaaactcacacatgcccaccgtgcccagcacct<br>gaactcctggggggaccgtcagtcttcctcttcc<br>ccccaaaacccaaggacaccctcatgatctcccg<br>gacccctgaggtcacatgcgtggtggtggacgtg<br>agccacgaagaccctgaggtcaagttcaactggt<br>acgtggacggcgtggaggtgcataatgccaagac<br>aaagccgcgggaggagcagtacaacagcacgtac<br>cgtgtggtcagcgtcctcaccgtcctgcaccagg<br>actggctgaatggcaaggagtacaagtgcaaggt<br>ctccaacaaagccctcccagcccccatcgagaaa<br>accatctccaaagccaaagggcagccccgagaac<br>cacaggtgtacaccctgcccccatcccgggatga<br>gctgaccaagaaccaggtcagcctgacctgcctg<br>gtcaaaggcttctatcccagcgacatcgccgtgg<br>agtgggagagcaatgggcagccggagaacaacta<br>caagaccacgcctcccgtgctggactccgacggc<br>tccttcttcctctacagcaagctcaccgtggaca<br>agagcaggtggcagcaggggaacgtcttctcatg<br>ctccgtgatgcatgaggctctgcacaaccactac<br>acgcagaagtccctctccctgtctccgggtaaat<br>ga | |
| | LC | gacatccagatgacccagtctccatcctccctgt<br>ctgcatctgtaggagacagagtcaecateaettg<br>ccgggcaggtcagagcattagcagcttttaaat<br>tggtatcagcagaagccagggaaagcccctaagc<br>tcctgatctatgctgcatccagtttgcaaagtgg<br>ggtcccatcaaggttcagtggcagtggatctggg<br>acagatttcactctcaccatcagcagtctccaac<br>ctgaagattttgcaacttactactgtcaacagag<br>ttacattacccccttcactttcggccctgggacc<br>aaggtggatatcaaacgaactgtggctgcaccat<br>ctgtcttcatcttccgccatctgatgagcagtt<br>gaaatctggaactgcctctgttgtgtgcctgctg<br>aataacttctatcccagagaggccaaagtacagt<br>ggaaggtggataacgccctccaatcgggtaactc<br>ccaggagagtgtcacagagcaggacagcaaggac<br>agcacctacagcctcagcagcaccctgacgctga<br>gcaaagcagactacgagaaacacaaagtctacgc<br>ctgcgaagtcacccatcagggcctgagctcgccc<br>gtcacaaagagcttcaacaggggagagtgttag | 377 |

Administration of Antibodies

The present invention provides methods for administering an anti-CoV-S antigen-binding protein of the present invention, e.g., those of Table 4, comprising introducing the antigen-binding protein into the body of a subject (e.g., a human). For example, the method comprises piercing the body of the subject with a needle of a syringe and injecting the antigen-binding protein into the body of the subject, e.g., into the vein, artery, tumor, muscular tissue or subcutis of the subject.

The present invention provides a vessel (e.g., a plastic or glass vial, e.g., with a cap or a chromatography column, hollow bore needle or a syringe cylinder) comprising an anti-CoV-S antigen-binding protein of the present invention, e.g., those of Table 4.

The present invention also provides an injection device comprising one or more antigen-binding proteins (e.g., antibody or antigen-binding fragment) that bind specifically to CoV-S, e.g., those of Table 4, or a pharmaceutical composition thereof. The injection device may be packaged into a kit. An injection device is a device that introduces a substance into the body of a subject via a parenteral route, e.g., intramuscular, subcutaneous or intravenous. For example, an injection device may be a syringe (e.g., pre-filled with the pharmaceutical composition, such as an auto-injector) which, for example, includes a cylinder or barrel for holding fluid to be injected (e.g., comprising the antibody or fragment or a pharmaceutical composition thereof), a needle for piecing skin and/or blood vessels for injection of the fluid; and a plunger for pushing the fluid out of the cylinder and through the needle bore. In an embodiment of the invention, an injection device that comprises an antigen-binding protein, e.g., an antibody or antigen-binding fragment thereof, from a combination of the present invention, or a pharmaceutical composition thereof is an intravenous (IV) injection device. Such a device can include the antigen-binding protein or a pharmaceutical composition thereof in a cannula or trocar/needle which may be attached to a tube which may be attached to a bag or reservoir for holding fluid (e.g., saline) introduced into the body of the subject through the cannula or trocar/needle. The antibody or fragment or a pharmaceutical composition thereof may, in an embodiment of the invention, be introduced into the device once the trocar and cannula are inserted into the vein of a subject and the trocar is removed from the inserted cannula. The IV device may, for example, be inserted into a peripheral vein (e.g., in the hand or arm); the superior vena cava or inferior vena cava, or within the right atrium of the heart (e.g., a central IV); or into a subclavian, internal jugular, or a femoral vein and, for example, advanced toward the heart until it reaches the superior vena cava or right atrium (e.g., a central venous line). In an embodiment of the invention, an injection device is an autoinjector; a jet injector or an external infusion pump. A jet injector uses a high-pressure narrow jet of liquid which penetrate the epidermis to introduce the antibody or fragment or a pharmaceutical composition thereof to a subject's body. External infusion pumps are medical devices that deliver the antibody or fragment or a pharmaceutical composition thereof into a subject's body in controlled amounts. External infusion pumps may be powered electrically or mechanically. Different pumps operate in different ways, for example, a syringe pump holds fluid in the reservoir of a syringe, and a moveable piston controls fluid delivery, an elastomeric pump holds fluid in a stretchable balloon reservoir, and pressure from the elastic walls of the balloon drives fluid delivery. In a peristaltic pump, a set of rollers pinches down on a length of flexible tubing, pushing fluid forward. In a multi-channel pump, fluids can be delivered from multiple reservoirs at multiple rates.

Preparation of Human Antibodies

Methods for generating human antibodies in transgenic mice are known in the art. Any such known methods can be used in the context of the present invention to make human antibodies that specifically bind to CoV-S. An immunogen comprising any one of the following can be used to generate antibodies to CoV-S. In certain embodiments of the invention, the antibodies of the invention are obtained from mice immunized with a full length, native CoV-S, or with a live attenuated or inactivated virus, or with DNA encoding the protein or fragment thereof. Alternatively, the CoV-S protein or a fragment thereof may be produced using standard biochemical techniques and modified and used as immunogen. In one embodiment of the invention, the immunogen is a recombinantly produced CoV-S protein or fragment thereof. In certain embodiments of the invention, the immunogen may be a CoV-S polypeptide vaccine. In certain embodiments, one or more booster injections may be administered. In certain embodiments, the immunogen may be a recombinant CoV-S polypeptide expressed in *E. coli* or in any other eukaryotic or mammalian cells such as Chinese hamster ovary (CHO) cells.

Using VELOCIMMUNE® technology (see, for example, U.S. Pat. No. 6,596,541, Regeneron Pharmaceuticals, VELOCIMMUNE®) or any other known method for generating monoclonal antibodies, high affinity chimeric antibodies to CoV-S can be initially isolated having a human variable region and a mouse constant region. The VELOCIMMUNE® technology involves generation of a transgenic mouse having a genome comprising human heavy and light chain variable regions operably linked to endogenous mouse constant region loci such that the mouse produces an antibody comprising a human variable region and a mouse constant region in response to antigenic stimulation. The DNA encoding the variable regions of the heavy and light chains of the antibody are isolated and operably linked to DNA encoding the human heavy and light chain constant regions. The DNA is then expressed in a cell capable of expressing the fully human antibody.

Generally, a VELOCIMMUNE® mouse is challenged with the antigen of interest, and lymphatic cells (such as B-cells) are recovered from the mice that express antibodies. The lymphatic cells may be fused with a myeloma cell line to prepare immortal hybridoma cell lines, and such hybridoma cell lines are screened and selected to identify hybridoma cell lines that produce antibodies specific to the antigen of interest. DNA encoding the variable regions of the heavy chain and light chain may be isolated and linked to desirable isotypic constant regions of the heavy chain and light chain. Such an antibody protein may be produced in a cell, such as a CHO cell. Alternatively, DNA encoding the antigen-specific chimeric antibodies or the variable domains of the light and heavy chains may be isolated directly from antigen-specific lymphocytes.

Initially, high affinity chimeric antibodies are isolated having a human variable region and a mouse constant region. As in the experimental section below, the antibodies are characterized and selected for desirable characteristics, including affinity, selectivity, epitope, etc. The mouse constant regions are replaced with a desired human constant region to generate the fully human antibody of the invention, for example wild-type or modified IgG1 or IgG4. While the constant region selected may vary according to specific use, high affinity antigen-binding and target specificity characteristics reside in the variable region.

Anti-Coronavirus Spike Protein Antibodies Comprising Fc Variants

According to certain embodiments of the present invention, anti-CoV-S antigen-binding proteins, e.g., antibodies or antigen-binding fragments, are provided comprising an Fc domain comprising one or more mutations, which, for example, enhance or diminish antibody binding to the FcRn receptor, e.g., at acidic pH as compared to neutral pH. For example, the present invention includes anti-CoV-S antibodies comprising a mutation in the $C_H2$ or a $C_H3$ region of the Fc domain, wherein the mutation(s) increases the affinity of the Fc domain to FcRn in an acidic environment (e.g., in an endosome where pH ranges from about 5.5 to about 6.0). Such mutations may result in an increase in serum half-life of the antibody when administered to an animal. Non-limiting examples of such Fc modifications include, e.g., a modification at position 250 (e.g., E or Q); 250 and 428 (e.g., L or F); 252 (e.g., L/Y/F/W or T), 254 (e.g., S or T), and 256 (e.g., S/R/Q/E/D or T); or a modification at position 428 and/or 433 (e.g., H/L/R/S/P/Q or K) and/or 434 (e.g., A, W, H, F or Y [N434A, N434W, N434H, N434F or N434Y]); or a modification at position 250 and/or 428; or a modification at position 307 or 308 (e.g., 308F, V308F), and 434. In one embodiment, the modification comprises a 428L (e.g., M428L) and 434S (e.g., N434S) modification; a 428L, 259I (e.g., V259I), and 308F (e.g., V308F) modification; a 433K (e.g., H433K) and a 434 (e.g., 434Y) modification; a 252, 254, and 256 (e.g., 252Y, 254T, and 256E) modification; a 250Q and 428L modification (e.g., T250Q and M428L); and a 307 and/or 308 modification (e.g., 308F or 308P). In yet another embodiment, the modification comprises a 265A (e.g., D265A) and/or a 297A (e.g., N297A) modification.

For example, the present invention includes anti-CoV-S antigen-binding proteins, e.g., antibodies or antigen-binding fragments, comprising an Fc domain comprising one or more pairs or groups of mutations selected from the group consisting of: 250Q and 248L (e.g., T250Q and M248L); 252Y, 254T and 256E (e.g., M252Y, S254T and T256E); 428L and 434S (e.g., M428L and N434S); 257I and 311I (e.g., P257I and Q311I); 257I and 434H (e.g., P257I and N434H); 376V and 434H (e.g., D376V and N434H); 307A, 380A and 434A (e.g., T307A, E380A and N434A); and 433K and 434F (e.g., H433K and N434F). In particular, antibodies designated mAb17090 and mAb15160_2 each contain M252Y, S254T and T256E modifications in the heavy chain constant region as compared to mAb14286 and mAb15160, respectively.

Anti-CoV-S antigen-binding proteins, e.g., antibodies and antigen-binding fragments thereof, that comprise a $V_H$ and/or $V_L$ as set forth herein comprising any possible combinations of the foregoing Fc domain mutations, are contemplated within the scope of the present invention.

The present invention also includes anti-CoV-S antigen-binding proteins, antibodies or antigen-binding fragments, comprising a $V_H$ set forth herein and a chimeric heavy chain constant ($C_H$) region, wherein the chimeric $C_H$ region comprises segments derived from the $C_H$ regions of more than one immunoglobulin isotype. For example, the antibodies of the invention may comprise a chimeric $C_H$ region comprising part or all of a $C_H2$ domain derived from a human IgG1, human IgG2 or human IgG4 molecule, combined with part or all of a $C_H3$ domain derived from a human IgG1, human IgG2 or human IgG4 molecule. According to certain embodiments, the antibodies of the invention comprise a chimeric $C_H$ region having a chimeric hinge region. For example, a chimeric hinge may comprise an "upper hinge" amino acid sequence (amino acid residues from positions 216 to 227 according to EU numbering) derived from a human IgG1, a human IgG2 or a human IgG4 hinge region, combined with a "lower hinge" sequence (amino acid residues from positions 228 to 236 according to EU numbering) derived from a human IgG1, a human IgG2 or a human IgG4 hinge region. According to certain embodiments, the chimeric hinge region comprises amino acid residues derived from a human IgG1 or a human IgG4 upper hinge and amino acid residues derived from a human IgG2 lower hinge. An antibody comprising a chimeric $C_H$ region as described herein may, in certain embodiments, exhibit modified Fc effector functions without adversely affecting the therapeutic or pharmacokinetic properties of the antibody. (See, e.g., WO2014/022540).

Immunoconjugates

The invention encompasses an anti-CoV-S antigen-binding proteins, e.g., antibodies or antigen-binding fragments, conjugated to another moiety, e.g., a therapeutic moiety (an "immunoconjugate"), such as a toxoid or an anti-viral drug to treat influenza virus infection. In an embodiment of the invention, an anti-CoV-S antibody or fragment is conjugated to any of the further therapeutic agents set forth herein. As used herein, the term "immunoconjugate" refers to an antigen-binding protein, e.g., an antibody or antigen-binding fragment, which is chemically or biologically linked to a radioactive agent, a cytokine, an interferon, a target or reporter moiety, an enzyme, a peptide or protein or a therapeutic agent. The antigen-binding protein may be linked to the radioactive agent, cytokine, interferon, target or reporter moiety, enzyme, peptide or therapeutic agent at any location along the molecule so long as it is able to bind its target (CoV-S). Examples of immunoconjugates include antibody-drug conjugates and antibody-toxin fusion proteins. In one embodiment of the invention, the agent may be a second, different antibody that binds specifically to CoV-S. The type of therapeutic moiety that may be conjugated to the anti-CoV-S antigen-binding protein (e.g., antibody or fragment) will take into account the condition to be treated and the desired therapeutic effect to be achieved. See, e.g., Arnon et al., "Monoclonal Antibodies For Immunotargeting Of Drugs In Cancer Therapy", Monoclonal Antibodies And Cancer Therapy, Reisfeld et al. (eds.), pp. 243-56 (Alan R. Liss, Inc. 1985); Hellstrom et al., "Antibodies For Drug Delivery", Controlled Drug Delivery ($2^{nd}$ Ed.), Robinson et al. (eds.), pp. 623-53 (Marcel Dekker, Inc. 1987); Thorpe, "Antibody Carriers Of Cytotoxic Agents In Cancer Therapy: A Review", Monoclonal Antibodies 1984: Biological And Clinical Applications, Pinchera et al. (eds.), pp. 475-506 (1985); "Analysis, Results, And Future Prospective Of The Therapeutic Use Of Radiolabeled Antibody In Cancer Therapy", Monoclonal Antibodies For Cancer Detection And Therapy, Baldwin et al. (eds.), pp. 303-16 (Academic Press 1985), and Thorpe et al., "The Preparation And Cytotoxic Properties Of Antibody-Toxin Conjugates", Immunol. Rev., 62: 119-58 (1982).

Multi-Specific Antibodies

The present invention includes anti-CoV-S antigen-binding proteins, e.g., antibodies and antigen-binding fragments thereof, as well as methods of use thereof and methods of making such antigen-binding proteins. The term "anti-CoV-S" antigen-binding proteins, e.g., antibodies or antigen-binding fragments, includes multispecific (e.g., bispecific or biparatopic) molecules that include at least one first antigen-binding domain that specifically binds to CoV-S (e.g., an antigen-binding domain from an antibody of Table 4) and at least one second antigen-binding domain that binds to a different antigen or to an epitope in CoV-S which is different from that of the first antigen-binding domain. In some embodiments, the first antigen-binding domain and the second antigen-binding domain are both selected from the antigen-binding domains of Table 4. In an embodiment of the invention, the first and second epitopes overlap. In another embodiment of the invention, the first and second epitopes do not overlap. For example, in an embodiment of the invention, a multispecific antibody is a bispecific IgG antibody (e.g., IgG1 or IgG4) that includes a first antigen-binding domain that binds specifically to CoV-S including the heavy and light immunoglobulin chain of an antibody of Table 4, and a second antigen-binding domain that binds specifically to a different epitope of CoV-S. In some embodiments, a bispecific IgG antibody (e.g., IgG1 or IgG4) includes a first antigen-binding domain that binds specifically to CoV-S and a second binding domain that binds to a host cell protein, e.g., ACE2 or TMPRSS2.

The antibodies of Table 4 include multispecific molecules, e.g., antibodies or antigen-binding fragments, that include the CDR-Hs and CDR-Ls, $V_H$ and $V_L$, or HC and LC of those antibodies, respectively (including variants thereof as set forth herein).

In an embodiment of the invention, an antigen-binding domain that binds specifically to CoV-S, which may be included in a multispecific molecule, comprises:

(1)
  (i) a heavy chain variable domain sequence that comprises HCDR1, HCDR2, and HCDR3 amino acid sequences set forth in Table 4, and
  (ii) a light chain variable domain sequence that comprises LCDR1, LCDR2, and LCDR3 amino acid sequences set forth in Table 4;

or, (2)
  (i) a heavy chain variable domain sequence comprising an amino acid sequence set forth in Table 4, and
  (ii) a light chain variable domain sequence comprising an amino acid sequence set forth in Table 4;

or, (3)
  (i) a heavy chain immunoglobulin sequence comprising an amino acid sequence set forth in Table 4, and (ii) a light chain immunoglobulin sequence comprising an amino acid sequence set forth in Table 4.

In an embodiment of the invention, the multispecific antibody or fragment includes more than two different binding specificities (e.g., a trispecific molecule), for example, one or more additional antigen-binding domains which are the same or different from the first and/or second antigen-binding domain.

In one embodiment of the invention, a bispecific antigen-binding fragment comprises a first scFv (e.g., comprising $V_H$ and $V_L$ sequences of Table 4) having binding specificity for a first epitope (e.g., CoV-S) and a second scFv having binding specificity for a second, different epitope. For example, in an embodiment of the invention, the first and second scFv are tethered with a linker, e.g., a peptide linker (e.g., a GS linker such as (GGGGS)$_n$ (SEQ ID NO: 834) wherein n is, for example, 1, 2, 3, 4, 5, 6, 7, 8, 9 or 10). Other bispecific antigen-binding fragments include an F(ab)$_2$ of a bispecific IgG antibody which comprises the heavy and light chain CDRs of Table 4 and of another antibody that binds to a different epitope.

Therapeutic Methods

The present invention provides methods for treating or preventing viral infection (e.g., coronavirus infection) by administering a therapeutically effective amount of anti-CoV-S antigen-binding protein, e.g., antibody or antigen-binding fragment, (e.g., of Table 4) to a subject (e.g., a human) in need of such treatment or prevention.

Coronavirus infection may be treated or prevented, in a subject, by administering an anti-CoV-S antigen-binding protein of the present invention to a subject. Exemplary coronaviruses include SARS-CoV-2, which may further include variants such as alpha, beta, gamma, delta, and omicron.

An effective or therapeutically effective dose of anti-CoV-S antigen-binding protein, e.g., antibody or antigen-binding fragment (e.g., of Table 4), for treating or preventing a viral infection refers to the amount of the antibody or fragment sufficient to alleviate one or more signs and/or symptoms of the infection in the treated subject, whether by inducing the regression or elimination of such signs and/or symptoms or by inhibiting the progression of such signs and/or symptoms. The dose amount may vary depending upon the age and the size of a subject to be administered, target disease, conditions, route of administration, and the like. In an embodiment of the invention, an effective or therapeutically effective dose of antibody or antigen-binding fragment thereof of the present invention, for treating or preventing viral infection, e.g., in an adult human subject, is about 0.01 to about 200 mg/kg, e.g., up to about 150 mg/kg. In an embodiment of the invention, the dosage is up to about 10.8 or 11 grams (e.g., about 1, 2, 3, 4, 5, 6, 7, 8, 9, 10 or 11 grams). Depending on the severity of the infection, the frequency and the duration of the treatment can be adjusted. In certain embodiments, the antigen-binding protein of the present invention can be administered at an initial dose, followed by one or more secondary doses. In certain embodiments, the initial dose may be followed by administration of a second or a plurality of subsequent doses of antibody or antigen-binding fragment thereof in an amount that can be approximately the same or less than that of the initial dose, wherein the subsequent doses are separated by at least 1 day to 3 days; at least one week, at least 2 weeks; at least 3 weeks; at least 4 weeks; at least 5 weeks; at least 6 weeks; at least 7 weeks; at least 8 weeks; at least 9 weeks; at least 10 weeks; at least 12 weeks; or at least 14 weeks.

In some embodiments, mAb10933 and mAb10987 (casirivimab and imdevimab, respectively) can be administered to a subject in a method of prophylaxis, e.g., pre-exposure prophylaxis, against symptomatic COVID-19. In some embodiments, the subject is immunocompromised, e.g., has an immunodeficiency such as a primary or secondary immunodeficiency. In some embodiments, the subject has not mounted an effective response to COVID-19 vaccination. Exemplary criteria associated with immune compromise include: active or recent treatment for solid tumor and hematologic malignancies; receipt of solid-organ or recent hematopoietic stem cell transplants; severe primary immunodeficiency; advanced or untreated HIV infection; active treatment with high-dose corticosteroids, alkylating agents, antimetabolites, tumor-necrosis (TNF) blockers, and other biologic agents that are immunosuppressive or immunomodulatory; and chronic medical conditions such as asplenia and chronic renal disease, in which some patients with these conditions may be associated with varying degrees of immune deficit. In some embodiments, a subject meets ≥1 of the following criteria:

a. Solid organ transplant (SOT) or hematopoietic blood cell transplant (HSCT) recipients receiving any immunosuppressive medication
b. Active hematologic malignancies or that have completed therapy within 3 months
c. Solid organ malignancies receiving active treatment with T cell or B cell immunosuppressive therapy
d. Moderate or severe primary immunodeficiency (such as hypogammaglobulinemia, Common variable immune deficiency, severe combined immunodeficiency)
e. HIV and CD4 <200 cells/microliter
f. Patients with rheumatologic disease, autoimmune disease, or multiple sclerosis receiving immunosuppressive therapy that modulates Th1, Th17 or B cell responses
g. Receiving any of the following immunosuppressant drugs for more than 3 weeks:
    - T cell suppressing agents (eg, ≥5 mg prednisone equivalent/day during >3 weeks), proteasome inhibitors (such as bortezomib, lenalidomide), alemtuzumab, anti-thymocyte globulin, CAR-T therapy, calcineurin inhibitors)
    - Alkylating agents
    - Purine analogs, such as fludarabine or cladribine
    - B cell depleting agents, such as rituximab and ocrelizumab
    - mTOR inhibitors
    - Antimetabolites, such as mycophenolate
    - JAK inhibitors.

Exemplary dosing regimens include:

Co-administration of mAb10933 and mAb10987 combination therapy, 1200 mg (600 mg per mAb) on day 1, then 600 mg (300 mg per mAb) subcutaneous (SC) every four weeks (Q4W)

Co-administration of mAb10933 and mAb10987 combination therapy, 300 mg (150 mg per mAb) SC Q4W; and Co-administration of mAb10933 and mAb10987 combination therapy, 300 mg (150 mg per mAb) SC Q12W.

As used herein, the term "subject" refers to a mammal (e.g., rat, mouse, cat, dog, cow, pig, sheep, horse, goat, rabbit), preferably a human, for example, in need of prevention and/or treatment of a disease or disorder such as viral infection or cancer. The subject may have a viral infection, e.g., an influenza infection, or be predisposed to developing an infection. Subjects predisposed to developing an infection, or subjects who may be at elevated risk for contracting an infection (e.g., of coronavirus or influenza virus), include subjects with compromised immune systems because of autoimmune disease, subjects receiving immunosuppressive therapy (for example, following organ transplant), subjects afflicted with human immunodeficiency syndrome (HIV) or acquired immune deficiency syndrome (AIDS), subjects with forms of anemia that deplete or destroy white blood cells, subjects receiving radiation or chemotherapy, or subjects afflicted with an inflammatory disorder. Additionally, subjects of very young (e.g., 5 years of age or younger) or old age (e.g., 65 years of age or older) are at increased risk. Moreover, a subject may be at risk of contracting a viral infection due to proximity to an outbreak of the disease, e.g. subject resides in a densely-populated city or in close proximity to subjects having confirmed or suspected infections of a virus, or choice of employment, e.g. hospital worker, pharmaceutical researcher, traveler to infected area, or frequent flier.

"Treat" or "treating" means to administer an anti-CoV-S antigen-binding protein, e.g., antibody or antigen-binding fragment of the present invention (e.g., of Table 4), to a subject having one or more signs or symptoms of a disease or infection, e.g., viral infection, for which the antigen-binding protein is effective when administered to the subject at an effective or therapeutically effective amount or dose (as discussed herein).

The present invention also encompasses prophylactically administering an anti-CoV-S antigen-binding protein, e.g., antibody or antigen-binding fragment thereof of the present invention (e.g., of Table 4), to a subject who is at risk of viral infection so as to prevent such infection. Passive antibody-based immunoprophylaxis has proven an effective strategy for preventing subject from viral infection. See e.g., Berry et al., Passive broad-spectrum influenza immunoprophylaxis. Influenza Res Treat. 2014; 2014:267594. Epub 2014 Sep. 22; and Jianqiang et al., Passive immune neutralization strategies for prevention and control of influenza A infections, Immunotherapy. 2012 February; 4(2): 175-186; Prabhu et al., Antivir Ther. 2009; 14(7):911-21, Prophylactic and therapeutic efficacy of a chimeric monoclonal antibody specific for H5 hemagglutinin against lethal H5N1 influenza. "Prevent" or "preventing" means to administer an anti-CoV-S antigen-binding protein, e.g., antibody or antigen-binding fragment of the present invention (e.g., of Table 4), to a subject to inhibit the manifestation of a disease or infection (e.g., viral infection) in the body of a subject, for which the antigen-binding protein is effective when administered to the subject at an effective or therapeutically effective amount or dose (as discussed herein). As used herein, prophylaxis can be pre-exposure prophylaxis (e.g., administration of an antibody or antigen-binding fragment described herein to an individual prior to exposure to the SARS-CoV-2 virus), or post-exposure prophylaxis (e.g., administration of an antibody or antigen-binding fragment described herein to an individual prior to exposure to the SARS-CoV-2 virus). In some embodiments, post-exposure prophylaxis can prevent one or more symptoms of COVID-19 despite infection with SARS-CoV-2.

In an embodiment of the invention, a sign or symptom of a viral infection in a subject is survival or proliferation of virus in the body of the subject, e.g., as determined by viral titer assay (e.g., coronavirus propagation in embryonated chicken eggs or coronavirus spike protein assay). Other signs and symptoms of viral infection are discussed herein.

As noted above, in some embodiments the subject may be a non-human animal, and the antigen-binding proteins (e.g., antibodies and antigen-binding fragments) discussed herein may be used in a veterinary context to treat and/or prevent disease in the non-human animals (e.g., cats, dogs, pigs, cows, horses, goats, rabbits, sheep, and the like).

The present invention provides a method for treating or preventing viral infection (e.g., coronavirus infection) or for inducing the regression or elimination or inhibiting the progression of at least one sign or symptom of viral infection such as:

fever or feeling feverish/chills;
cough;
sore throat;
runny or stuffy nose;
sneezing;
muscle or body aches;
headaches;
fatigue (tiredness);
vomiting;
diarrhea;
respiratory tract infection;
chest discomfort;
shortness of breath;
bronchitis; and/or
pneumonia, which sign or symptom is secondary to viral infection, in a subject in need thereof (e.g., a human), by administering a therapeutically effective amount of anti-CoV-S antigen-binding protein (e.g., of Table 4) to the subject, for example, by injection of the protein into the body of the subject.

Combinations and Pharmaceutical Compositions

To prepare pharmaceutical compositions of the anti-CoV-S antigen-binding proteins, e.g., antibodies and antigen-binding fragments thereof (e.g., of Table 4), antigen-binding protein is admixed with a pharmaceutically acceptable carrier or excipient. See, e.g., Remington's Pharmaceutical Sciences and U.S. Pharmacopeia: National Formulary, Mack Publishing Company, Easton, Pa. (1984); Hardman, et al. (2001) Goodman and Gilman's The Pharmacological Basis of Therapeutics, McGraw-Hill, New York, N.Y.; Gennaro (2000) Remington: The Science and Practice of Pharmacy, Lippincott, Williams, and Wilkins, New York, N.Y.; Avis, et al. (eds.) (1993) Pharmaceutical Dosage Forms: Parenteral Medications, Marcel Dekker, NY; Lieberman, et al. (eds.) (1990) Pharmaceutical Dosage Forms: Tablets, Marcel Dekker, NY; Lieberman, et al. (eds.) (1990) Pharmaceutical Dosage Forms: Disperse Systems, Marcel Dekker, NY; Weiner and Kotkoskie (2000) Excipient Toxicity and Safety, Marcel Dekker, Inc., New York, N.Y. In an embodiment of the invention, the pharmaceutical composition is sterile. Such compositions are part of the present invention.

The scope of the present invention includes desiccated, e.g., freeze-dried, compositions comprising an anti-CoV-S antigen-binding proteins, e.g., antibody or antigen-binding fragment thereof (e.g., of Table 4), or a pharmaceutical composition thereof that includes a pharmaceutically acceptable carrier but substantially lacks water.

In a further embodiment of the invention, a further therapeutic agent that is administered to a subject in association with an anti-CoV-S antigen-binding protein, e.g., antibody or antigen-binding fragment thereof (e.g., of Table 4), disclosed herein is administered to the subject in accordance with the Physicians' Desk Reference 2003 (Thomson Healthcare; 57$^{th}$ edition (Nov. 1, 2002)).

The mode of administration can vary. Routes of administration include oral, rectal, transmucosal, intestinal, parenteral; intramuscular, subcutaneous, intradermal, intramedullary, intrathecal, direct intraventricular, intravenous, intraperitoneal, intranasal, intraocular, inhalation, insufflation, topical, cutaneous, transdermal or intra-arterial.

The present invention provides methods for administering an anti-CoV-S antigen-binding protein, e.g., antibody or antigen-binding fragment thereof (e.g., of Table 4), comprising introducing the protein into the body of a subject. For example, the method comprises piercing the body of the subject with a needle of a syringe and injecting the antigen-binding protein into the body of the subject, e.g., into the vein, artery, tumor, muscular tissue or subcutis of the subject.

The present invention provides a vessel (e.g., a plastic or glass vial, e.g., with a cap or a chromatography column, hollow bore needle or a syringe cylinder) comprising any of the anti-CoV-S antigen-binding proteins, e.g., antibodies or antigen-binding fragments thereof (e.g., of Table 4), polypeptides (e.g., an HC, LC, $V_H$ or $V_L$ of Table 4) or polynucleotides (e.g., of Table 5) or vectors set forth herein or a pharmaceutical composition thereof comprising a pharmaceutically acceptable carrier.

In an embodiment of the present disclosure, an anti-CoV-S antigen-binding protein, e.g., antibody or antigen-binding fragment thereof of the present invention (e.g., of Table 4), is administered in association with one or more further therapeutic agents. A further therapeutic agent includes, but is not limited to: an anti-inflammatory agent, an antimalarial agent, a second antibody or antigen-binding fragment thereof that specifically binds TMPRSS2, and a second antibody or antigen-binding fragment thereof that specifically binds to CoV-S (e.g., an antibody described herein, or described in U.S. Pat. No. 10,787,501 which is hereby specifically incorporated by reference in its entirety). In some embodiments, an antimalarial agent is chloroquine or hydroxychloroquine. In some embodiments, an anti-inflammatory agent is an antibody such as sarilumab, tocilizumab, or gimsilumab. In some embodiments, the further therapeutic agent is a second antibody or antigen-binding fragment disclosed herein, e.g, of Table 4. In some cases, the antibody that binds to CoV-S is casirivimab or imdevimab, in certain embodiments, one, two, three, four, or more antibodies, or antigen-binding fragments thereof, of Table 4 can be administered in combination (e.g., concurrently or sequentially). In particular, combinations of antibodies can be selected such that the antibodies do not cross-compete, as described in Example 7. In some embodiments, mAb14256 is administered in combination with mAb14315. In some embodiments, mAb15151 is administered in combination with mAb14315. In some embodiments, an antibody (e.g., one antibody or two antibodies) of the present disclosure can be combined with an antibody (e.g., one antibody or two antibodies) described in U.S. Pat. No. 10,787,501 ("the '501 patent"). In certain embodiments, mAb10987 of the '501 patent is administered in combination with mAb14256 and/or mAb15151 of the present disclosure. In certain embodiments, mAb10933 and mAb10987 of the '501 patent are administered in combination with mAb14256 of the present disclosure. In certain embodiments, mAb10985 and mAb10987 of the '501 patent are administered in combination with mAb15151 of the present disclosure. In certain embodiments, mAb10985 of the '501 patent is administered in combination with mAb14315 and/or mAb15151 of the present disclosure. In certain embodiments, mAb15160 of the present disclosure is administered in combination with mAb10987 of the '501 patent. In certain embodiments, mAb15160 of the present disclosure is administered in combination with mAb10985 of the '501 patent, In certain embodiments, mAb15160 of the present disclosure is administered in combination with mAb10985 and mAb10987 of the '501 patent. In certain embodiments, mAb15160 of the present disclosure is administered in combination with any one, two, or three of mAb14256, mAb14315, and mAb15151, optionally further administered with mAb10987 and/or mAb10985, In certain embodiments, any one of, two of, three of, of four of mAb14256, mAb14315, mAb15151, and mAb15160 is administered in combination with i) mAb10933, ii) mAb10987, or iii) mAb10933 and mAb10987. In certain embodiments, any combination of one, two, three, four, five, six, or seven of mAb10933, mAb10987, mAb10985, mAb14256, mAb1435, mAb15151; and mAb15160 is administered in combination. In certain embodiments, an antibody or antigen-binding fragment thereof selected from mAb10987, mAb14284, mAb14315 and mAb17090 is combined with an antibody or antigen-binding fragment thereof selected from mAb10933, mAb14256, mAb15160 and mAb15160_2. In certain embodiments, the combination comprises mAb10987 and mAb10933. In certain embodiments, the combination comprises mAb10987 and mAb14256. In certain embodiments, the combination comprises mAb10987 and mAb15160. In certain embodiments, the combination comprises mAb10987 and mAb15160_2. In certain embodiments, the combination comprises mAb14284 and mAb10933. In certain embodiments, the combination comprises mAb14284 and mAb14256. In certain embodiments, the combination comprises mAb14284 and mAb15160. In certain embodiments, the combination comprises mAb14284 and mAb15160_2. In certain embodiments, the combination comprises mAb14315 and mAb10933. In certain embodiments, the combination comprises mAb14315 and mAb14256. In certain embodiments, the combination comprises mAb14315 and mAb15160. In certain embodiments, the combination comprises mAb14315 and mAb15160_2. In certain embodiments, the combination comprises mAb17090 and mAb10933. In certain embodiments, the combination comprises mAb17090 and mAb14256. In certain embodiments, the combination comprises mAb17090 and mAb15160. In certain embodiments, the combination comprises mAb17090 and mAb15160_2. In any of the combinations discussed above or herein, the antibody or antigen-binding fragment may be defined by the CDRs contained within the HCVR and LCVR sequences identified in Table 4, by the heavy and light chain CDR sequences identified in Table 4, by the HCVR and LCVR sequences identified in Table 4, or by the full-length heavy and light chain sequences identified in Table 4, and each of these specific combinations is encompassed within the present disclosure. Certain exemplary combinations of two antibodies are shown below. In some embodiments, an antibody that specifically binds TMPRSS2 is H1H7017N, as described in International Patent Pub. No. WO/2019/147831.

TABLE 2

Exemplary Combinations of Two Antibodies

| mAb/Combination No. | mAb 10933 | mAb 10985 | mAb 10987 | mAb 14256 | mAb 14315 | mAb 15151 | mAb 14284 | mAb 17090 | mAb 15160 | mAb 15160_2 |
|---|---|---|---|---|---|---|---|---|---|---|
| mAb10933 | X | 1 | 2 | 3 | 4 | 5 | 6 | 7 | 8 | 9 |
| mAb10985 | 10 | X | 11 | 12 | 13 | 14 | 15 | 16 | 17 | 18 |
| mAb10987 | 19 | 20 | X | 21 | 22 | 23 | 24 | 25 | 26 | 27 |
| mAb14256 | 28 | 29 | 30 | X | 31 | 32 | 33 | 34 | 35 | 36 |
| mAb14315 | 37 | 38 | 39 | 40 | X | 41 | 42 | 43 | 44 | 45 |
| mAb15151 | 46 | 47 | 48 | 49 | 50 | X | 51 | 52 | 53 | 54 |
| mAb14284 | 55 | 56 | 57 | 58 | 59 | 60 | X | 61 | 62 | 63 |
| mAb17090 | 64 | 65 | 66 | 67 | 68 | 69 | 70 | X | 71 | 72 |
| mAb15160 | 73 | 74 | 75 | 76 | 77 | 78 | 79 | 80 | X | 81 |
| mAb15160_2 | 82 | 83 | 84 | 85 | 86 | 87 | 88 | 89 | 90 | X |

TABLE 3

Exemplary Sequences from U.S. Pat. No. 10,787,501

| Antibody Designation | Component Part | Sequence | SEQ ID NO |
|---|---|---|---|
| mAb10933 | | Amino Acids | |
| | HCVR | QVQLVESGGGLVKPGGSLRLSCAASGFTFSDYYMSWIRQAPGKGLEWVSYITYSGSTIYYADSVKGRFTISRDNAKSSLYLQMNSLRAEDTAVYYCARDRGTTMVPFDYWGQGTLVTVSS | 1010 |
| | HCDR1 | GFTFSDYY | 1012 |
| | HCDR2 | ITYSGSTI | 1014 |
| | HCDR3 | ARDRGTTMVPFDY | 1016 |
| | LCVR | DIQMTQSPSSLSASVGDRVTITCQASQDITNYLNWYQQKPGKAPKLLIYAASNLETGVPSRFSGSGSGTDFTFTISGLQPEDIATYYCQQYDNLPLTFGGGTKVEIK | 1018 |
| | LCDR1 | QDITNY | 1020 |
| | LCDR2 | AAS | 1022 |
| | LCDR3 | QQYDNLPLT | 1024 |
| | HC | QVQLVESGGGLVKPGGSLRLSCAASGFTFSDYYMSWIRQAPGKGLEWVSYITYSGSTIYYADSVKGRFTISRDNAKSSLYLQMNSLRAEDTAVYYCARDRGTTMVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK | 1026 |
| | LC | DIQMTQSPSSLSASVGDRVTITCQASQDITNYLNWYQQKPGKAPKLLIYAASNLETGVPSRFSGSGSGTDFTFTISGLQPEDIATYYCQQYDNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 1028 |
| | | Nucleic Acids | |
| | HCVR | CAGGTGCAGCTGGTGGAGTCTGGGGGAGGCTTGGTCAAGCCTGGAGGGTCCCTGAGACTCTCCTGTGCAGCCTCTGGATTCACCTTCAGTGACTACTACATGAGCTGGATCCGCCAGGCTCCAGGGAAGGGGCTGGAGTGGGTTTCATACATTACTTATAGTGGTAGTACCATATACTACGCAGACTCTGTGAAGGGCCGATTCACCATCTCCAGGGACAACGCCAAGAGCTCACTGTATCTGCAAATGAACAGCCTGAGAGCCGAGGACACGGCCGTGTATTACTGTGCGAGAGATCGCGGTACAACTATGGTCCCCTTTGACTACTGGGGCCAGGGAACCCTGGTCACCGTCTCCTCA | 1009 |

TABLE 3-continued

Exemplary Sequences from U.S. Pat. No. 10,787,501

| Antibody Designation | Component Part | Sequence | SEQ ID NO |
|---|---|---|---|
| | HCDR1 | GGATTCACCTTCAGTGACTACTAC | 1011 |
| | HCDR2 | ATTACTTATAGTGGTAGTACCATA | 1013 |
| | HCDR3 | GCGAGAGATCGCGGTACAACTATGGTCCCCTTTG ACTAC | 1015 |
| | LCVR | GACATCCAGATGACCCAGTCTCCATCCTCCCTGT CTGCATCTGTAGGAGACAGAGTCACCATCACTTG CCAGGCGAGTCAGGACATTACCAACTATTTAAAT TGGTATCAGCAGAAACCAGGGAAAGCCCCTAAGC TCCTGATCTACGCTGCATCCAATTTGGAAACAGG GGTCCCATCAAGGTTCAGTGGAAGTGGATCTGGG ACAGATTTTACTTTCACCATCAGCGGCCTGCAGC CTGAAGATATTGCAACATATTACTGTCAACAGTA TGATAATCTCCCTCTCACTTTCGGCGGAGGGACC AAGGTGGAGATCAAA | 1017 |
| | LCDR1 | CAGGACATTACCAACTAT | 1019 |
| | LCDR2 | GCTGCATCC | 1021 |
| | LCDR3 | CAACAGTATGATAATCTCCCTCTCACT | 1023 |
| | HC | CAGGTGCAGCTGGTGGAGTCTGGGGGAGGCTTGG TCAAGCCTGGAGGGTCCCTGAGACTCTCCTGTGC AGCCTCTGGATTCACCTTCAGTGACTACTACATG AGCTGGATCCGCCAGGCTCCAGGGAAGGGGCTGG AGTGGGTTTCATACATTACTTATAGTGGTAGTAC CATATACTACGCAGACTCTGTGAAGGGCCGATTC ACCATCTCCAGGGACAACGCCAAGAGCTCACTGT ATCTGCAAATGAACAGCCTGAGAGCCGAGGACAC GGCCGTGTATTACTGTGCGAGAGATCGCGGTACA ACTATGGTCCCCTTTGACTACTGGGGCCAGGGAA CCCTGGTCACCGTCTCCTCAGCCTCCACCAAGGG CCCATCGGTCTTCCCCCTGGCACCCTCCTCCAAG AGCACCTCTGGGGGCACAGCGGCCCTGGGCTGCC TGGTCAAGGACTACTTCCCCGAACCGGTGACGGT GTCGTGGAACTCAGGCGCCCTGACCAGCGGCGTG CACACCTTCCCGGCTGTCCTACAGTCCTCAGGAC TCTACTCCCTCAGCAGCGTGGTGACCGTGCCCTC CAGCAGCTTGGGCACCCAGACCTACATCTGCAAC GTGAATCACAAGCCCAGCAACACCAAGGTGGACA AGAAAGTTGAGCCCAAATCTTGTGACAAAACTCA CACATGCCCACCGTGCCCAGCACCTGAACTCCTG GGGGGACCGTCAGTCTTCCTCTTCCCCCCAAAAC CCAAGGACACCCTCATGATCTCCCGGACCCCTGA GGTCACATGCGTGGTGGTGGACGTGAGCCACGAA GACCCTGAGGTCAAGTTCAACTGGTACGTGGACG GCGTGGAGGTGCATAATGCCAAGACAAAGCCGCG GGAGGAGCAGTACAACAGCACGTACCGTGTGGTC AGCGTCCTCACCGTCCTGCACCAGGACTGGCTGA ATGGCAAGGAGTACAAGTGCAAGGTCTCCAACAA AGCCCTCCCAGCCCCCATCGAGAAAACCATCTCC AAAGCCAAAGGGCAGCCCCGAGAACCACAGGTGT ACACCCTGCCCCCATCCCGGGATGAGCTGACCAA GAACCAGGTCAGCCTGACCTGCCTGGTCAAAGGC TTCTATCCCAGCGACATCGCCGTGGAGTGGGAGA GCAATGGGCAGCCGGAGAACAACTACAAGACCAC GCCTCCCGTGCTGGACTCCGACGGCTCCTTCTTC CTCTACAGCAAGCTCACCGTGGACAAGAGCAGGT GGCAGCAGGGGAACGTCTTCTCATGCTCCGTGAT GCATGAGGCTCTGCACAACCACTACACGCAGAAG TCCCTCTCCCTGTCTCCGGGTAAATGA | 1025 |
| | LC | GACATCCAGATGACCCAGTCTCCATCCTCCCTGT CTGCATCTGTAGGAGACAGAGTCACCATCACTTG CCAGGCGAGTCAGGACATTACCAACTATTTAAAT TGGTATCAGCAGAAACCAGGGAAAGCCCCTAAGC TCCTGATCTACGCTGCATCCAATTTGGAAACAGG GGTCCCATCAAGGTTCAGTGGAAGTGGATCTGGG ACAGATTTTACTTTCACCATCAGCGGCCTGCAGC CTGAAGATATTGCAACATATTACTGTCAACAGTA TGATAATCTCCCTCTCACTTTCGGCGGAGGGACC AAGGTGGAGATCAAACGAACTGTGGCTGCACCAT CTGTCTTCATCTTCCCGCCATCTGATGAGCAGTT GAAATCTGGAACTGCCTCTGTTGTGTGCCTGCTG AATAACTTCTATCCCAGAGAGGCCAAAGTACAGT | 1027 |

TABLE 3-continued

Exemplary Sequences from U.S. Pat. No. 10,787,501

| Antibody Designation | Component Part | Sequence | SEQ ID NO |
|---|---|---|---|
| | | GGAAGGTGGATAACGCCCTCCAATCGGGTAACTC CCAGGAGAGTGTCACAGAGCAGGACAGCAAGGAC AGCACCTACAGCCTCAGCAGCACCCTGACGCTGA GCAAAGCAGACTACGAGAAACACAAAGTCTACGC CTGCGAAGTCACCCATCAGGGCCTGAGCTCGCCC GTCACAAAGAGCTTCAACAGGGGAGAGTGTTAG | |
| mAb10987 | | Amino Acids | |
| | HCVR | QVQLVESGGGVVQPGRSLRLSCAASGFTFSNYAM YWVRQAPGKGLEWVAVISYDGSNKYYADSVKGRF TISRDNSKNTLYLQMNSLRTEDTAVYYCASGSDY GDYLLVYWGQGTLVTVSS | 1030 |
| | HCDR1 | GFTFSNYA | 1032 |
| | HCDR2 | ISYDGSNK | 1034 |
| | HCDR3 | ASGSDYGDYLLVY | 1036 |
| | LCVR | QSALTQPASVSGSPGQSITISCTGTSSDVGGYNY VSWYQQHPGKAPKLMIYDVSKRPSGVSNRFSGSK SGNTASLTISGLQSEDEADYYCNSLTSISTWVFG GGTKLTVL | 1038 |
| | LCDR1 | SSDVGGYNY | 1040 |
| | LCDR2 | DVS | 1042 |
| | LCDR3 | NSLTSISTWV | 1044 |
| | HC | QVQLVESGGGVVQPGRSLRLSCAASGFTFSNYAM YWVRQAPGKGLEWVAVISYDGSNKYYADSVKGRF TISRDNSKNTLYLQMNSLRTEDTAVYYCASGSDY GDYLLVYWGQGTLVTVSSASTKGPSVFPLAPSSK STSGGTAALGCLVKDYFPEPVTVSWNSGALTSGV HTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALPAPIEKTIS KAKGQPREPQVYTLPPSRDELTKNQVSLTCLVKG FYPSDIAVEWESNGQPENNYKTTPPVLDSDGSFF LYSKLTVDKSRWQQGNVFSCSVMHEALHNHYTQK SLSLSPGK | 1046 |
| | LC | QSALTQPASVSGSPGQSITISCTGTSSDVGGYNY VSWYQQHPGKAPKLMIYDVSKRPSGVSNRFSGSK SGNTASLTISGLQSEDEADYYCNSLTSISTWVFG GGTKLTVLGQPKAAPSVTLFPPSSEELQANKATL VCLISDFYPGAVTVAWKADSSPVKAGVETTTPSK QSNNKYAASSYLSLTPEQWKSHRSYSCQVTHEGS TVEKTVAPTECS | 1048 |
| | | Nucleic Acids | |
| | HCVR | CAGGTGCAGCTGGTGGAGTCTGGGGGAGGCGTGG TCCAGCCTGGGAGGTCCCTGAGACTCTCCTGTGC AGCCTCTGGATTCACCTTCAGTAACTATGCTATG TACTGGGTCCGCCAGGCTCCAGGCAAGGGGCTGG AGTGGGTGGCAGTTATATCATATGATGGAAGTAA TAAATACTATGCAGACTCCGTGAAGGGCCGATTC ACCATCTCCAGAGACAATTCCAAGAACACGCTGT ATCTGCAAATGAACAGCCTGAGAACTGAGGACAC GGCTGTGTATTACTGTGCGAGTGGCTCCGACTAC GGTGACTACTTATTGGTTTACTGGGGCCAGGGAA CCCTGGTCACCGTCTCCTCA | 1029 |
| | HCDR1 | GGATTCACCTTCAGTAACTATGCT | 1031 |
| | HCDR2 | ATATCATATGATGGAAGTAATAAA | 1033 |
| | HCDR3 | GCGAGTGGCTCCGACTACGGTGACTACTTATTGG TTTAC | 1035 |
| | LCVR | CAGTCTGCCCTGACTCAGCCTGCCTCCGTGTCTG GGTCTCCTGGACAGTCGATCACCATCTCCTGCAC TGGAACCAGCAGTGACGTTGGTGGTTAT7XACTAT GTCTCCTGGTACCAACAACACCCAGGCAAAGCCC CCAAACTCATGATTTATGATGTCAGTAAGCGGCC CTCAGGGGTTTCTAATCGCTTCTCTGGCTCCAAG TCTGGCAACACGGCCTCCCTGACCATCTCTGGGC TCCAGTCTGAGGACGAGGCTGATTATTACTGCAA CTCTTTGACAAGCATCAGCACTTGGGTGTTCGGC GGAGGGACCAAGCTGACCGTCCTA | 1037 |
| | LCDR1 | AGCAGTGACGTTGGTGGTTATAACTAT | 1039 |
| | LCDR2 | GATGTCAGT | 1041 |
| | LCDR3 | AACTCTTTGACAAGCATCAGCACTTGGGTG | 1043 |
| | HC | CAGGTGCAGCTGGTGGAGTCTGGGGGAGGCGTGG | 1045 |

TABLE 3-continued

Exemplary Sequences from U.S. Pat. No. 10,787,501

| Antibody Designation | Component Part | Sequence | SEQ ID NO |
|---|---|---|---|
| | | TCCAGCCTGGGAGGTCCCTGAGACTCTCCTGTGC AGCCTCTGGATTCACCTTCAGTAACTATGCTATG TACTGGGTCCGCCAGGCTCCAGGCAAGGGGCTGG AGTGGGTGGCAGTTATATCATATGATGGAAGTAA TAAATACTATGCAGACTCCGTGAAGGGCCGATTC ACCATCTCCAGAGACAATTCCAAGAACACGCTGT ATCTGCAAATGAACAGCCTGAGAACTGAGGACAC GGCTGTGTATTACTGTGCGAGTGGCTCCGACTAC GGTGACTACTTATTGGTTTACTGGGGCCAGGGAA CCCTGGTCACCGTCTCCTCAGCCTCCACCAAGGG CCCATCGGTCTTCCCCCTGGCACCCTCCTCCAAG AGCACCTCTGGGGGCACAGCGGCCCTGGGCTGCC TGGTCAAGGACTACTTCCCCGAACCGGTGACGGT GTCGTGGAACTCAGGCGCCCTGACCAGCGGCGTG CACACCTTCCCGGCTGTCCTACAGTCCTCAGGAC TCTACTCCCTCAGCAGCGTGGTGACCGTGCCCTC CAGCAGCTTGGGCACCCAGACCTACATCTGCAAC GTGAATCACAAGCCCAGCAACACCAAGGTGGACA AGAAAGTTGAGCCCAAATCTTGTGACAAAACTCA CACATGCCCACCGTGCCCAGCACCTGAACTCCTG GGGGGACCGTCAGTCTTCCTCTTCCCCCCAAAAC CCAAGGACACCCTCATGATCTCCCGGACCCCTGA GGTCACATGCGTGGTGGTGGACGTGAGCCACGAA GACCCTGAGGTCAAGTTCAACTGGTACGTGGACG GCGTGGAGGTGCATAATGCCAAGACAAAGCCGCG GGAGGAGCAGTACAACAGCACGTACCGTGTGGTC AGCGTCCTCACCGTCCTGCACCAGGACTGGCTGA ATGGCAAGGAGTACAAGTGCAAGGTCTCCAACAA AGCCCTCCCAGCCCCCATCGAGAAAACCATCTCC AAAGCCAAAGGGCAGCCCCGAGAACCACAGGTGT ACACCCTGCCCCCATCCCGGGATGAGCTGACCAA GAACCAGGTCAGCCTGACCTGCCTGGTCAAGGC TTCTATCCCAGCGACATCGCCGTGGAGTGGGAGA GCAATGGGCAGCCGGAGAACAACTACAAGACCAC GCCTCCCGTGCTGGACTCCGACGGCTCCTTCTTC CTCTACAGCAAGCTCACCGTGGACAAGAGCAGGT GGCAGCAGGGGAACGTCTTCTCATGCTCCGTGAT GCATGAGGCTCTGCACAACCACTACACGCAGAAG TCCCTCTCCCTGTCTCCGGGTAAATGA | |
| | LC | CAGTCTGCCCTGACTCAGCCTGCCTCCGTGTCTG GGTCTCCTGGACAGTCGATCACCATCTCCTGCAC TGGAACCAGCAGTGACGTTGGTGGTTATAACTAT GTCTCCTGGTACCAACAACACCCAGGCAAAGCCC CCAAACTCATGATTTATGATGTCAGTAAGCGGCC CTCAGGGGTTTCTAATCGCTTCTCTGGCTCCAAG TCTGGCAACACGGCCTCCCTGACCATCTCTGGGC TCCAGTCTGAGGACGAGGCTGATTATTACTGCAA CTCTTTGACAAGCATCAGCACTTGGGTGTTCGGC GGAGGGACCAAGCTGACCGTCCTAGGCCAGCCCA AGGCCGCCCCCTCCGTGACCCTGTTCCCCCCCTC CTCCGAGGAGCTGCAGGCCAACAAGGCCACCCTG GTGTGCCTGATCTCCGACTTCTACCCCGGCGCCG TGACCGTGGCCTGGAAGGCCGACTCCTCCCCCGT GAAGGCCGGCGTGGAGACCACCACCCCCTCCAAG CAGTCCAACAACAAGTACGCCGCCTCCTCCTACC TGTCCCTGACCCCCGAGCAGTGGAAGTCCCACCG GTCCTACTCCTGCCAGGTGACCCACGAGGGCTCC ACCGTGGAGAAGACCGTGGCCCCCACCGAGTGCT CCTGA | 1047 |
| mAb10985 | | Amino Acids | |
| | HCVR | EVQLVESGGGLVQPGRSLRLSCAASGFTFDDYAM HWVRQAPGKGLEWVSGISWNRGSIGYADSVKGRF TISRDNAKNSLYLQMSSLRAEDTALYYCAKDGER WDSWVPSARNGMDVWGQGTTVTVSS | 1050 |
| | HCDR1 | GFTFDDYA | 1052 |
| | HCDR2 | ISWNRGSI | 1054 |
| | HCDR3 | AKDGERWDSVVVPSARNGMDV | 1056 |
| | LCVR | QSVLTQPPSVSGAPGQRVTISCTGSSSNIGAGYD VHWYQQLPGTAPKLLIYGNSNRPSGVPDRFSGSK SGTSASLAITGLQAEDEADYYCQSYDSSLSGSYV FGTGTKVTVL | 1058 |
| | LCDR1 | SSNIGAGYD | 1060 |
| | LCDR2 | GNS | 1062 |

TABLE 3-continued

Exemplary Sequences from U.S. Pat. No. 10,787,501

| Antibody Designation | Component Part | Sequence | SEQ ID NO |
|---|---|---|---|
| | LCDR3 | QSYDSSLSGSYV | 1064 |
| | HC | EVQLVESGGGLVQPGRSLRLSCAASGFTFDDYAM HWVRQAPGKGLEWVSGISWNRGSIGYADSVKGRF TISRDNAKNSLYLQMSSLRAEDTALYYCAKDGER WDSVVVPSARNGMDVWGQGTTVTVSSASTKGPSV FPLAPSSKSTSGGTAALGCLVKDYFPEPVTVSWN SGALTSGVHTFPAVLQSSGLYSLSSVVTVPSSSL GTQTYICNVNHKPSNTKVDKKVEPKSCDKTHTCP PCPAPELLGGPSVFLFPPKPKDTLMISRTPEVTC VVVDVSHEDPEVKFNWYVDGVEVHNAKTKPREEQ YNSTYRVVSVLTVLHQDWLNGKEYKCKVSNKALP APIEKTISKAKGQPREPQVYTLPPSRDELTKNQV SLTCLVKGFYPSDIAVEWESNGQPENNYKTTPPV LDSDGSFFLYSKLTVDKSRWQQGNVFSCSVMHEA LHNHYTQKSLSLSPGK | 1066 |
| | LC | QSVLTQPPSVSGAPGQRVTISCTGSSSNIGAGYD VHWYQQLPGTAPKLLIYGNSNRPSGVPDRFSGSK SGTSASLAITGLQAEDEADYYCQSYDSSLSGSYV FGTGTKVTVLGQPKAAPSVTLFPPSSEELQANKA TLVCLISDFYPGAVTVAWKADSSPVKAGVETTTP SKQSNNKYAASSYLSLTPEQWKSHRSYSCQVTHE GSTVEKTVAPTECS | 1068 |

Nucleic Acids

| | HCVR | GAAGTGCAGCTGGTGGAGTCTGGGGGAGGCTTGG TACAGCCTGGCAGGTCCCTGAGACTCTCCTGTGC AGCCTCTGGATTCACCTTTGATGATTATGCCATG CACTGGGTCCGGCAAGCTCCAGGGAAGGGCCTGG AGTGGGTCTCAGGTATTAGTTGGAATAGGGGTAG CATAGGCTATGCGGACTCTGTGAAGGGCCGATTC ACCATCTCCAGAGACAACGCCAAGAACTCCCTGT ATCTGCAAATGAGCAGTCTGAGAGCTGAGGACAC GGCCTTGTATTACTGCGCAAAAGATGGCGAGAGA TGGGATAGTGTAGTAGTACCATCTGCTAGGAACG GTATGGACGTCTGGGGCCAAGGGACCACGGTCAC CGTCTCCTCA | 1049 |
| | HCDR1 | GGATTCACCTTTGATGATTATGCC | 1051 |
| | HCDR2 | ATTAGTTGGAATAGGGGTAGCATA | 1053 |
| | HCDR3 | GCAAAAGATGGCGAGAGATGGGATAGTGTAGTAG TACCATCTGCTAGGAACGGTATGGACGTC | 1055 |
| | LCVR | CAGTCTGTGCTGACGCAGCCGCCCTCAGTGTCTG GGGCCCCAGGGCAGAGGGTCACCATCTCCTGCAC TGGGAGCAGCTCCAACATCGGGGCAGGTTATGAT GTACATTGGTACCAGCAGCTTCCAGGAACAGCCC CCAAACTCCTCATCTATGGTAACAGCAATCGGCC CTCAGGGGTCCCTGACCGATTCTCTGGCTCCAAG TCTGGCACCTCAGCCTCCCTGGCCATCACTGGGC TCCAGGCTGAGGATGAGGCTGATTATTACTGCCA GTCCTATGACAGCAGCCTGAGTGGCTCTTATGTC TTCGGAACTGGGACCAAGGTCACCGTCCTA | 1057 |
| | LCDR1 | AGCTCCAACATCGGGGCAGGTTATGAT | 1059 |
| | LCDR2 | GGTAACAGC | 1061 |
| | LCDR3 | CAGTCCTATGACAGCAGCCTGAGTGGCTCTTATG TC | 1063 |
| | HC | GAAGTGCAGCTGGTGGAGTCTGGGGGAGGCTTGG TACAGCCTGGCAGGTCCCTGAGACTCTCCTGTGC AGCCTCTGGATTCACCTTTGATGATTATGCCATG CACTGGGTCCGGCAAGCTCCAGGGAAGGGCCTGG AGTGGGTCTCAGGTATTAGTTGGAATAGGGGTAG CATAGGCTATGCGGACTCTGTGAAGGGCCGATTC ACCATCTCCAGAGACAACGCCAAGAACTCCCTGT ATCTGCAAATGAGCAGTCTGAGAGCTGAGGACAC GGCCTTGTATTACTGCGCAAAAGATGGCGAGAGA TGGGATAGTGTAGTAGTACCATCTGCTAGGAACG GTATGGACGTCTGGGGCCAAGGGACCACGGTCAC CGTCTCCTCAGCCTCCACCAAGGGCCCATCGGTC | 1065 |

TABLE 3-continued

Exemplary Sequences from U.S. Pat. No. 10,787,501

| Antibody Designation | Component Part | Sequence | SEQ ID NO |
|---|---|---|---|
| | | TTCCCCCTGGCACCCTCCTCCAAGAGCACCTCTG<br>GGGGCACAGCGGCCCTGGGCTGCCTGGTCAAGGA<br>CTACTTCCCCGAACCGGTGACGGTGTCGTGGAAC<br>TCAGGCGCCCTGACCAGCGGCGTGCACACCTTCC<br>CGGCTGTCCTACAGTCCTCAGGACTCTACTCCCT<br>CAGCAGCGTGGTGACCGTGCCCTCCAGCAGCTTG<br>GGCACCCAGACCTACATCTGCAACGTGAATCACA<br>AGCCCAGCAACACCAAGGTGGACAAGAAAGTTGA<br>GCCCAAATCTTGTGACAAAACTCACACATGCCCA<br>CCGTGCCCAGCACCTGAACTCCTGGGGGGACCGT<br>CAGTCTTCCTCTTCCCCCCAAAACCCAAGGACAC<br>CCTCATGATCTCCCGGACCCCTGAGGTCACATGC<br>GTGGTGGTGGACGTGAGCCACGAAGACCCTGAGG<br>TCAAGTTCAACTGGTACGTGGACGGCGTGGAGGT<br>GCATAATGCCAAGACAAAGCCGCGGGAGGAGCAG<br>TACAACAGCACGTACCGTGTGGTCAGCGTCCTCA<br>CCGTCCTGCACCAGGACTGGCTGAATGGCAAGGA<br>GTACAAGTGCAAGGTCTCCAACAAAGCCCTCCCA<br>GCCCCCATCGAGAAAACCATCTCCAAAGCCAAAG<br>GGCAGCCCCGAGAACCACAGGTGTACACCCTGCC<br>CCCATCCCGGGATGAGCTGACCAAGAACCAGGTC<br>AGCCTGACCTGCCTGGTCAAAGGCTTCTATCCCA<br>GCGACATCGCCGTGGAGTGGGAGAGCAATGGGCA<br>GCCGGAGAACAACTACAAGACCACGCCTCCCGTG<br>CTGGACTCCGACGGCTCCTTCTTCCTCTACAGCA<br>AGCTCACCGTGGACAAGAGCAGGTGGCAGCAGGG<br>GAACGTCTTCTCATGCTCCGTGATGCATGAGGCT<br>CTGCACAACCACTACACGCAGAAGTCCCTCTCCC<br>TGTCTCCGGGTAAATGA | |
| | LC | CAGTCTGTGCTGACGCAGCCGCCCTCAGTGTCTG<br>GGGCCCCAGGGCAGAGGGTCACCATCTCCTGCAC<br>TGGGAGCAGCTCCAACATCGGGGCAGGTTATGAT<br>GTACATTGGTACCAGCAGCTTCCAGGAACAGCCC<br>CCAAACTCCTCATCTATGGTAACAGCAATCGGCC<br>CTCAGGGGTCCCTGACCGATTCTCTGGCTCCAAG<br>TCTGGCACCTCAGCCTCCCTGGCCATCACTGGGC<br>TCCAGGCTGAGGATGAGGCTGATTATTACTGCCA<br>GTCCTATGACAGCAGCCTGAGTGGCTCTTATGTC<br>TTCGGAACTGGGACCAAGGTCACCGTCCTAGGCC<br>AGCCCAAGGCCGCCCCCTCCGTGACCCTGTTCCC<br>CCCCTCCTCCGAGGAGCTGCAGGCCAACAAGGCC<br>ACCCTGGTGTGCCTGATCTCCGACTTCTACCCCG<br>GCGCCGTGACCGTGGCCTGGAAGGCCGACTCCTC<br>CCCCGTGAAGGCCGGCGTGGAGACCACCACCCCC<br>TCCAAGCAGTCCAACAACAAGTACGCCGCCTCCT<br>CCTACCTGTCCCTGACCCCCGAGCAGTGGAAGTC<br>CCACCGGTCCTACTCCTGCCAGGTGACCCACGAG<br>GGCTCCACCGTGGAGAAGACCGTGGCCCCCACCG<br>AGTGCTCCTGA | 1067 |

In some embodiments, anti-CoV-S antigen-binding proteins (e.g., anti-SARS-CoV-2-S antibodies or antigen-binding fragments thereof) from different human donors may be combined. The present invention includes a composition comprising two (or more) anti-SARS-CoV-2-S antibodies or antigen-binding fragments comprising variable domains from human subjects, wherein the two (or more) antibodies or antigen-binding fragments are derived from different subjects (e.g., two different human subjects). Antibody variable regions derived from human B cells are discussed, e.g., in Examples 1 and 2 (Table 6), which describes that variable domains cloned from such B cells are combined with a constant region not from those B cells to produce hybrid antibodies.

In some embodiments, the further therapeutic agent is an anti-viral drug and/or a vaccine. As used herein, the term "anti-viral drug" refers to any anti-infective drug or therapy used to treat, prevent, or ameliorate a viral infection in a subject. The term "anti-viral drug" includes, but is not limited to a cationic steroid antimicrobial, leupeptin, aprotinin, ribavirin, or interferon-alpha2b. Methods for treating or preventing virus (e.g., coronavirus) infection in a subject in need of said treatment or prevention by administering an antibody or antigen-binding fragment of Table 4 in association with a further therapeutic agent are part of the present invention.

For example, in an embodiment of the invention, the further therapeutic agent is a vaccine, e.g., a coronavirus vaccine. In an embodiment of the invention, a vaccine is an inactivated/killed virus vaccine, a live attenuated virus vaccine or a virus subunit vaccine.

For example, in an embodiment of the invention, the further therapeutic agent is:

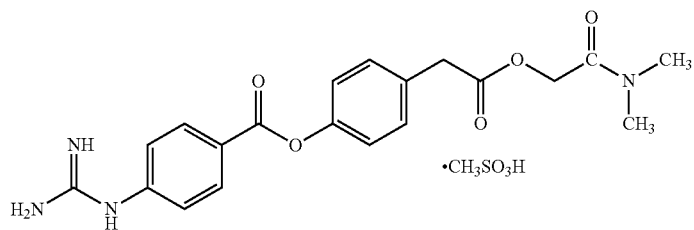
(camostat mesylate);
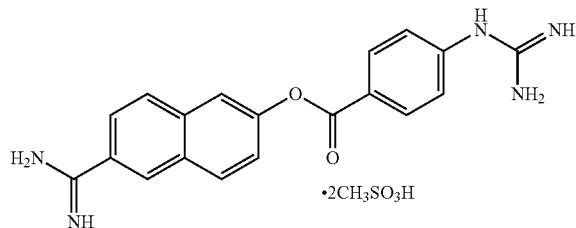
(nafamostat mesylate);
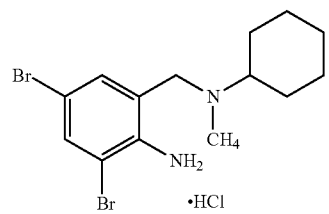
(bromhexine hydrochloride (BHH));
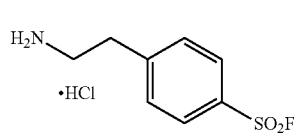
(4-(2-aminomethyl)benzenesulfonyl fluoride hydrochloride (AEBSF));
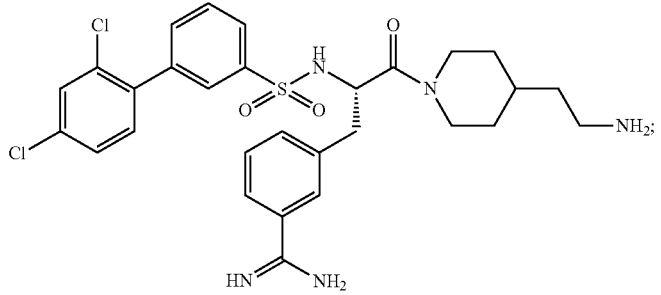
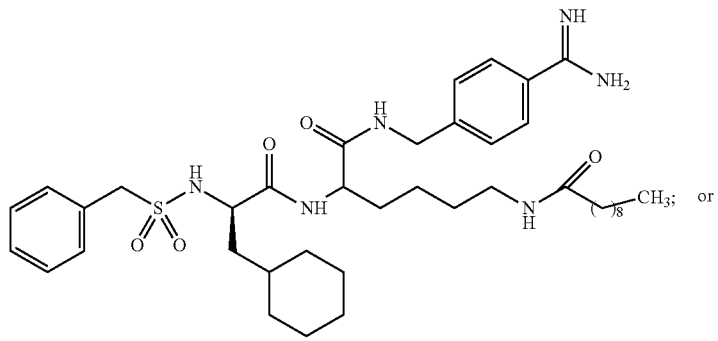 or

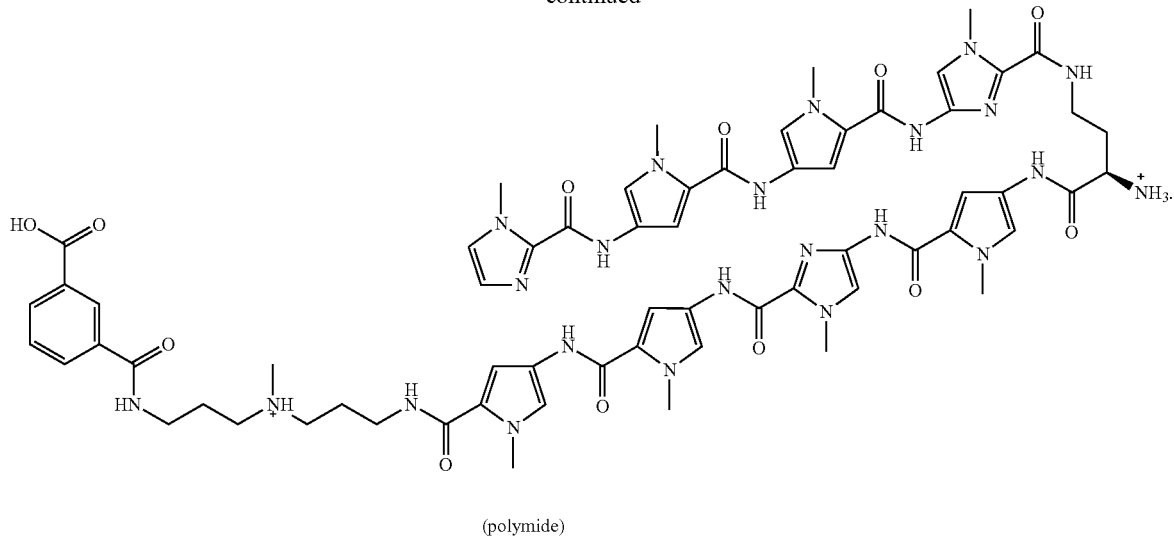

(polymide)

See Shen et al. Biochimie 142: 1-10 (2017).

In an embodiment of the invention, the anti-viral drug is an antibody or antigen-binding fragment that binds specifically to coronavirus, e.g., SARS-CoV-2, SARS-CoV, or MERS-CoV. Exemplary anti-CoV-S antibodies include, but are not limited to: H4sH15188P; H1H15188P; H1H15211P; H1H15177P; H4sH15211P; H1H15260P2; H1H15259P2; H1H15203P; H4sH15260P2; H4sH15231P2; H1H15237P2; H1H15208P; H1H15228P2; H1H15233P2; H1H15264P2; H1H15231P2; H1H15253P2; H1H15215P; and H1H15249P2, as set forth in International patent application publication no. WO/2015/179535, or an antigen-binding fragment thereof, e.g., wherein the antibody or fragment comprises a light chain immunoglobulin that includes LCDR1, LCDR2 and LCDR3 (e.g., the $V_L$ or light chain thereof); and a heavy chain that includes HCDR1, HCDR2 and HCDR3 (e.g., the $V_H$ or heavy chain thereof) of any of the foregoing anti-CoV-S antibodies.

In a certain embodiment of the invention, the further therapeutic agent is not aprotinin, leupeptin, a cationic steroid antimicrobial, an influenza vaccine (e.g., killed, live, attenuated whole virus or subunit vaccine), or an antibody against influenza virus (e.g., an anti-hemagglutinin antibody).

The term "in association with" indicates that the components, an anti-CoV-S antigen-binding protein, e.g., antibody or antigen-binding fragment thereof of the present invention, along with another agent, can be formulated into a single composition, e.g., for simultaneous delivery, or formulated separately into two or more compositions (e.g., a kit). Each component can be administered to a subject at a different time than when the other component is administered; for example, each administration may be given non-simultaneously (e.g., separately or sequentially) at intervals over a given period of time. Moreover, the separate components may be administered to a subject by the same or by a different route (e.g., wherein an anti-CoV-S antibody or antigen-binding fragment thereof.

Kits

Further provided are kits comprising one or more components that include, but are not limited to, an anti-CoV-S antigen-binding protein, e.g., an antibody or antigen-binding fragment as discussed herein (e.g., of Table 4), in association with one or more additional components including, but not limited to, a further therapeutic agent, as discussed herein. The antigen-binding protein and/or the further therapeutic agent can be formulated as a single composition or separately in two or more compositions, e.g., with a pharmaceutically acceptable carrier, in a pharmaceutical composition.

In one embodiment of the invention, the kit includes an anti-CoV-S antigen-binding protein, e.g., an antibody or antigen-binding fragment thereof of the invention (e.g., of Table 4), or a pharmaceutical composition thereof in one container (e.g., in a sterile glass or plastic vial) and a further therapeutic agent in another container (e.g., in a sterile glass or plastic vial).

In another embodiment, the kit comprises a combination of the invention, including an anti-CoV-S antigen-binding protein, e.g., antibody or antigen-binding fragment thereof of the invention (e.g., of Table 4), or pharmaceutical composition thereof in combination with one or more further therapeutic agents formulated together, optionally, in a pharmaceutical composition, in a single, common container.

If the kit includes a pharmaceutical composition for parenteral administration to a subject, the kit can include a device (e.g., an injection device) for performing such administration. For example, the kit can include one or more hypodermic needles or other injection devices as discussed above containing the anti-CoV-S antigen-binding protein, e.g., antibody or antigen-binding fragment thereof of the present invention (e.g., of Table 4).

The kit can include a package insert including information concerning the pharmaceutical compositions and dosage forms in the kit. Generally, such information aids patients and physicians in using the enclosed pharmaceutical compositions and dosage forms effectively and safely. For example, the following information regarding a combination of the invention may be supplied in the insert: pharmacokinetics, pharmacodynamics, clinical studies, efficacy parameters, indications and usage, contraindications, warnings, precautions, adverse reactions, overdosage, proper dosage and administration, how supplied, proper storage conditions, references, manufacturer/distributor information and patent information.

Diagnostic Uses of the Antibodies

The anti-CoV-S antigen-binding proteins, e.g., antibodies or antigen-binding fragments thereof of the present invention (e.g., of Table 4), may be used to detect and/or measure CoV-S in a sample. Exemplary assays for CoV-S may include, e.g., contacting a sample with an anti-CoV-S antigen-binding protein of the invention, wherein the anti-CoV-S antigen-binding protein is labeled with a detectable label or reporter molecule or used as a capture ligand to selectively isolate CoV-S from samples. The presence of an anti-CoV-S antigen-binding protein complexed with CoV-S indicates the presence of CoV-S in the sample. Alternatively, an unlabeled anti-CoV-S antibody can be used in combination with a secondary antibody which is itself detectably labeled. The detectable label or reporter molecule can be a radioisotope, such as $^{3}H$, $^{14}C$, $^{32}P$, $^{35}S$, or $^{125}I$; a fluorescent or chemiluminescent moiety such as fluorescein isothiocyanate, or rhodamine; or an enzyme such as alkaline phosphatase, β-galactosidase, horseradish peroxidase, or luciferase. Specific exemplary assays that can be used to detect or measure CoV-S in a sample include neutralization assays, enzyme-linked immunosorbent assay (ELISA), radioimmunoassay (RIA), and fluorescence-activated cell sorting (FACS). Thus, the present invention includes a method for detecting the presence of spike protein polypeptide in a sample comprising contacting the sample with an anti-CoV-S antigen-binding protein and detecting the presence of a CoV-S/anti-CoV-S antigen-binding protein wherein the presence of the complex indicates the presence of CoV-S.

An anti-CoV-S antigen-binding protein of the invention (e.g., of Table 4) may be used in a Western blot or immune-protein blot procedure for detecting the presence of CoV-S or a fragment thereof in a sample. Such a procedure forms part of the present invention and includes the steps of e.g.:

providing a membrane or other solid substrate comprising a sample to be tested for the presence of CoV-S, e.g., optionally including the step of transferring proteins from a sample to be tested for the presence of CoV-S (e.g., from a PAGE or SDS-PAGE electrophoretic separation of the proteins in the sample) onto a membrane or other solid substrate using a method known in the art (e.g., semi-dry blotting or tank blotting); and contacting the membrane or other solid substrate to be tested for the presence of CoV-S or a fragment thereof with an anti-CoV-S antigen-binding protein of the invention.

Such a membrane may take the form, for example, of a nitrocellulose or vinyl-based (e.g., polyvinylidene fluoride (PVDF)) membrane to which the proteins to be tested for the presence of CoV-S in a non-denaturing PAGE (polyacrylamide gel electrophoresis) gel or SDS-PAGE (sodium dodecyl sulfate polyacrylamide gel electrophoresis) gel have been transferred (e.g., following electrophoretic separation in the gel). Before contacting the membrane with the anti-CoV-S antigen-binding protein, the membrane is optionally blocked, e.g., with non-fat dry milk or the like so as to bind non-specific protein binding sites on the membrane.

(2) washing the membrane one or more times to remove unbound anti-CoV-S antigen-binding protein and other unbound substances; and (3) detecting the bound anti-CoV-S antigen-binding protein.

Detection of the bound antigen-binding protein indicates that the CoV-S protein is present on the membrane or substrate and in the sample. Detection of the bound antigen-binding protein may be by binding the antigen-binding protein with a secondary antibody (an anti-immunoglobulin antibody) which is detectably labeled and, then, detecting the presence of the secondary antibody label.

The anti-CoV-S antigen-binding proteins (e.g., antibodies and antigen-binding fragments (e.g., of Table 4)) disclosed herein may also be used for immunohistochemistry. Such a method forms part of the present invention and comprises, e.g., contacting tissue to be tested for the presence of CoV-S protein with an anti-CoV-S antigen-binding protein of the invention; and detecting the antigen-binding protein on or in the tissue.

If the antigen-binding protein itself is detectably labeled, it can be detected directly. Alternatively, the antigen-binding protein may be bound by a detectably labeled secondary antibody wherein the label is then detected.

EXAMPLES

The following examples are put forth so as to provide those of ordinary skill in the art with a complete disclosure and description of how to make and use the methods and compositions of the invention and are not intended to limit the scope of what the inventors regard as their invention. Efforts have been made to ensure accuracy with respect to numbers used (e.g., amounts, temperature, etc.) but some experimental errors and deviations should be accounted for. Unless indicated otherwise, parts are parts by weight, molecular weight is average molecular weight, temperature is in degrees Centigrade, room temperature is about 25° C., and pressure is at or near atmospheric.

Example 1: Generation of Human Antibodies to SARS-CoV-2 Spike Protein (SARS-CoV-2-S)

Human antibodies to SARS-CoV-2-Spike protein (SARS-CoV-2-S) were generated in a VELOCIMMUNE® mouse comprising DNA encoding human immunoglobulin heavy and kappa light chain variable regions or human immunoglobulin heavy and lambda light chain variable regions. Each mouse was immunized with a vector expressing the SARS-CoV-2-S receptor binding domain (RBD) (amino acids 1-1273 of NCBI accession number (MN908947.3), SEQ ID NO: 1008), followed by a booster with a SARS-CoV-2-S vector or a SARS-CoV-2-S protein. The antibody immune response was monitored by a SARS-CoV-2-S-specific immunoassay. Anti-SARS-CoV-2-S antibodies were isolated directly from antigen-positive mouse B cells without fusion to myeloma cells, as described in U.S. Pat. No. 7,582,298, herein specifically incorporated by reference in its entirety. Using this method, fully human anti-SARS-CoV-2-S antibodies (i.e., antibodies possessing human variable domains and human constant domains) were obtained.

Antibody variable regions were also isolated from human blood samples. Whole blood was received from patients 6-8 weeks after a laboratory-confirmed PCR positive test for SARS-CoV-2 and symptomatic COVID-19 disease. Red blood cells were lysed using an ammonium chloride based lysis buffer (Life Technologies) and B cells were enriched by negative selection. Single B cells that bound the SARS-CoV-2 spike protein were isolated by fluorescent-activated cell sorting (FACS). Isolated B cells were single-well plated and mixed with antibody light and heavy variable region-specific PCR primers. cDNAs for each single B cell were synthesized via a reverse transcriptase (RT) reaction. Each resulting RT product was then split and transferred into two corresponding wells for subsequent antibody heavy and light chain PCRs. One set of the resulting RT products was first amplified by PCR using a 5' degenerate primer specific for antibody heavy variable region leader sequence or a 5' degenerate primer specific for antibody light chain variable region leader sequence and a 3' primer specific for antibody constant region, to form an amplicon. The amplicons were then amplified again by PCR using a 5' degenerate primer specific for antibody heavy variable region framework 1 or a 5' degenerate primer specific for antibody light chain variable region framework 1 and a 3' primer specific for antibody constant region, to generate amplicons for cloning. The antibody heavy chain and light chain derived PCR products were cloned into expression vectors containing heavy constant region and light constant region, respectively, thereby producing expression vectors for hybrid antibodies. The expression vectors expressing full-length heavy and light chain pairs were transfected into CHO cells to produce antibody proteins for testing.

The biological properties of exemplary antibodies generated in accordance with the methods of this Example are described in detail in the Examples set forth below.

Example 2: Heavy and Light Chain Variable Region Amino Acid and Nucleotide Sequences Table 4 sets forth the amino acid sequence identifiers of the heavy and light chain variable regions and CDRs, as well as the heavy chain and light chain sequences, of exemplary anti-SARS-CoV-2-S antibodies. The corresponding nucleic acid sequence identifiers are set forth in Table 5.

TABLE 4

Amino Acid Sequence Identifiers
SEQ ID NOs

| mAb | HCVR | HCDR1 | HCDR2 | HCDR3 | LCVR | LCDR1 | LCDR2 | LCDR3 | HC | LC |
|---|---|---|---|---|---|---|---|---|---|---|
| mAb15163 | 2 | 4 | 6 | 8 | 10 | 12 | 14 | 16 | 18 | 20 |
| mAb15164 | 22 | 24 | 26 | 28 | 30 | 32 | 34 | 36 | 38 | 40 |
| mAb15165 | 42 | 44 | 26 | 47 | 49 | 51 | 34 | 36 | 54 | 56 |
| mAb15166 | 58 | 60 | 62 | 64 | 66 | 51 | 68 | 36 | 70 | 72 |
| mAb15167 | 74 | 76 | 78 | 80 | 82 | 84 | 86 | 88 | 90 | 92 |
| mAb15170 | 94 | 96 | 98 | 100 | 102 | 104 | 106 | 108 | 110 | 112 |
| mAb14296 | 114 | 116 | 118 | 120 | 122 | 124 | 126 | 128 | 130 | 132 |
| mAb14297 | 134 | 136 | 138 | 140 | 142 | 144 | 126 | 146 | 148 | 150 |
| mAb14312 | 152 | 154 | 156 | 158 | 160 | 162 | 164 | 166 | 168 | 170 |
| mAb14313 | 172 | 174 | 176 | 178 | 180 | 182 | 184 | 186 | 188 | 190 |
| mAb14314 | 192 | 194 | 196 | 198 | 200 | 202 | 204 | 206 | 208 | 210 |
| mAb14315 | 212 | 214 | 216 | 218 | 220 | 222 | 126 | 224 | 226 | 228 |
| mAb14316 | 230 | 232 | 234 | 236 | 238 | 240 | 242 | 244 | 246 | 248 |
| mAb15150 | 250 | 252 | 254 | 256 | 258 | 260 | 262 | 264 | 266 | 268 |
| mAb15151 | 270 | 272 | 274 | 276 | 278 | 280 | 106 | 282 | 284 | 286 |
| mAb15156 | 288 | 290 | 292 | 294 | 296 | 298 | 300 | 302 | 304 | 306 |
| mAb15157 | 308 | 310 | 312 | 314 | 316 | 318 | 320 | 322 | 324 | 326 |
| mAb15158 | 328 | 330 | 332 | 334 | 336 | 338 | 106 | 340 | 342 | 344 |
| mAb15159 | 346 | 96 | 98 | 350 | 352 | 354 | 106 | 356 | 358 | 360 |
| mAb15160 | 362 | 364 | 366 | 368 | 370 | 372 | 106 | 374 | 376 | 378 |
| mAb15161 | 380 | 382 | 384 | 386 | 388 | 390 | 392 | 394 | 396 | 398 |
| mAb15162 | 400 | 402 | 98 | 405 | 407 | 409 | 242 | 411 | 413 | 415 |
| mAb14280 | 417 | 419 | 421 | 423 | 425 | 427 | 14 | 429 | 431 | 433 |
| mAb14281 | 435 | 437 | 138 | 440 | 442 | 444 | 446 | 448 | 450 | 452 |
| mAb14282 | 454 | 456 | 458 | 460 | 462 | 84 | 465 | 467 | 469 | 471 |
| mAb14283 | 473 | 475 | 477 | 479 | 481 | 483 | 485 | 487 | 489 | 491 |
| mAb14284 | 493 | 495 | 497 | 499 | 501 | 503 | 505 | 507 | 509 | 511 |
| mAb14285 | 513 | 515 | 517 | 519 | 521 | 523 | 525 | 36 | 527 | 529 |
| mAb14286 | 531 | 533 | 535 | 537 | 539 | 483 | 542 | 544 | 546 | 548 |
| mAb14287 | 550 | 552 | 554 | 556 | 558 | 84 | 14 | 560 | 562 | 564 |
| mAb14288 | 566 | 568 | 570 | 572 | 574 | 576 | 578 | 580 | 582 | 584 |
| mAb14289 | 586 | 588 | 590 | 592 | 594 | 596 | 126 | 598 | 600 | 602 |
| mAb14290 | 604 | 606 | 608 | 610 | 612 | 614 | 126 | 616 | 618 | 620 |
| mAb14291 | 622 | 624 | 626 | 628 | 630 | 632 | 634 | 636 | 638 | 640 |
| mAb14292 | 642 | 644 | 646 | 648 | 650 | 652 | 634 | 655 | 657 | 659 |
| mAb14293 | 661 | 663 | 665 | 667 | 669 | 124 | 126 | 671 | 673 | 675 |
| mAb14295 | 677 | 679 | 78 | 682 | 684 | 686 | 126 | 688 | 690 | 692 |
| mAb13459 | 694 | 696 | 698 | 700 | 702 | 704 | 706 | 708 | 710 | 712 |
| mAb14230 | 714 | 696 | 716 | 718 | 720 | 722 | 126 | 724 | 726 | 728 |
| mAb14231 | 730 | 732 | 734 | 736 | 738 | 740 | 106 | 742 | 744 | 746 |
| mAb14232 | 748 | 750 | 497 | 752 | 754 | 756 | 505 | 758 | 760 | 762 |
| mAb14233 | 764 | 766 | 768 | 770 | 772 | 774 | 776 | 778 | 780 | 782 |
| mAb14234 | 784 | 786 | 788 | 790 | 792 | 794 | 796 | 798 | 800 | 802 |
| mAb14235 | 804 | 806 | 497 | 808 | 810 | 812 | 505 | 814 | 816 | 818 |
| mAb14247 | 820 | 822 | 497 | 825 | 827 | 756 | 14 | 829 | 831 | 833 |
| mAb14248 | 835 | 837 | 839 | 841 | 843 | 845 | 847 | 849 | 851 | 853 |
| mAb14249 | 855 | 857 | 859 | 861 | 863 | 865 | 106 | 867 | 869 | 871 |
| mAb14255 | 873 | 76 | 876 | 878 | 880 | 84 | 86 | 36 | 883 | 885 |
| mAb14256 | 887 | 889 | 891 | 893 | 895 | 897 | 164 | 899 | 901 | 903 |
| mAb14257 | 905 | 154 | 908 | 910 | 912 | 914 | 916 | 166 | 918 | 920 |
| mAb14258 | 922 | 924 | 926 | 928 | 930 | 576 | 933 | 935 | 937 | 939 |
| mAb14259 | 941 | 943 | 945 | 947 | 949 | 951 | 634 | 655 | 953 | 955 |
| mAb14260 | 957 | 959 | 961 | 963 | 965 | 967 | 969 | 971 | 973 | 975 |
| mAb13457 | 694 | 696 | 698 | 700 | 977 | 704 | 706 | 979 | 710 | 981 |
| mAb13458 | 694 | 696 | 698 | 700 | 983 | 704 | 706 | 985 | 710 | 987 |
| mAb14294 | 989 | 991 | 993 | 995 | 997 | 999 | 1001 | 1003 | 1005 | 1007 |

TABLE 4-continued

Amino Acid Sequence Identifiers
SEQ ID NOs

| mAb | HCVR | HCDR1 | HCDR2 | HCDR3 | LCVR | LCDR1 | LCDR2 | LCDR3 | HC | LC |
|---|---|---|---|---|---|---|---|---|---|---|
| mAb17090 | 493 | 495 | 497 | 499 | 501 | 503 | 505 | 507 | 1075 | 511 |
| mAb15160_2 | 362 | 364 | 366 | 368 | 370 | 372 | 106 | 374 | 1077 | 378 |

TABLE 5

Nucleic Acid Sequence Identifiers
SEQ ID NOs

| mAb | HCVR | HCDR1 | HCDR2 | HCDR3 | LCVR | LCDR1 | LCDR2 | LCDR3 | HC | LC |
|---|---|---|---|---|---|---|---|---|---|---|
| mAb15163 | 1 | 3 | 5 | 7 | 9 | 11 | 13 | 15 | 17 | 19 |
| mAb15164 | 21 | 23 | 25 | 27 | 29 | 31 | 33 | 35 | 37 | 39 |
| mAb15165 | 41 | 43 | 45 | 46 | 48 | 50 | 33 | 52 | 53 | 55 |
| mAb15166 | 57 | 59 | 61 | 63 | 65 | 50 | 67 | 52 | 69 | 71 |
| mAb15167 | 73 | 75 | 77 | 79 | 81 | 83 | 85 | 87 | 89 | 91 |
| mAb15170 | 93 | 95 | 97 | 99 | 101 | 103 | 105 | 107 | 109 | 111 |
| mAb14296 | 113 | 115 | 117 | 119 | 121 | 123 | 125 | 127 | 129 | 131 |
| mAb14297 | 133 | 135 | 137 | 139 | 141 | 143 | 125 | 145 | 147 | 149 |
| mAb14312 | 151 | 153 | 155 | 157 | 159 | 161 | 163 | 165 | 167 | 169 |
| mAb14313 | 171 | 173 | 175 | 177 | 179 | 181 | 183 | 185 | 187 | 189 |
| mAb14314 | 191 | 193 | 195 | 197 | 199 | 201 | 203 | 205 | 207 | 209 |
| mAb14315 | 211 | 213 | 215 | 217 | 219 | 221 | 125 | 223 | 225 | 227 |
| mAb14316 | 229 | 231 | 233 | 235 | 237 | 239 | 241 | 243 | 245 | 247 |
| mAb15150 | 249 | 251 | 253 | 255 | 257 | 259 | 261 | 263 | 265 | 267 |
| mAb15151 | 269 | 271 | 273 | 275 | 277 | 279 | 105 | 281 | 283 | 285 |
| mAb15156 | 287 | 289 | 291 | 293 | 295 | 297 | 299 | 301 | 303 | 305 |
| mAb15157 | 307 | 309 | 311 | 313 | 315 | 317 | 319 | 321 | 323 | 325 |
| mAb15158 | 327 | 329 | 331 | 333 | 335 | 337 | 105 | 339 | 341 | 343 |
| mAb15159 | 345 | 347 | 348 | 349 | 351 | 353 | 105 | 355 | 357 | 359 |
| mAb15160 | 361 | 363 | 365 | 367 | 369 | 371 | 105 | 373 | 375 | 377 |
| mAb15161 | 379 | 381 | 383 | 385 | 387 | 389 | 391 | 393 | 395 | 397 |
| mAb15162 | 399 | 401 | 403 | 404 | 406 | 408 | 241 | 410 | 412 | 414 |
| mAb14280 | 416 | 418 | 420 | 422 | 424 | 426 | 13 | 428 | 430 | 432 |
| mAb14281 | 434 | 436 | 438 | 439 | 441 | 443 | 445 | 447 | 449 | 451 |
| mAb14282 | 453 | 455 | 457 | 459 | 461 | 463 | 464 | 466 | 468 | 470 |
| mAb14283 | 472 | 474 | 476 | 478 | 480 | 482 | 484 | 486 | 488 | 490 |
| mAb14284 | 492 | 494 | 496 | 498 | 500 | 502 | 504 | 506 | 508 | 510 |
| mAb14285 | 512 | 514 | 516 | 518 | 520 | 522 | 524 | 52 | 526 | 528 |
| mAb14286 | 530 | 532 | 534 | 536 | 538 | 540 | 541 | 543 | 545 | 547 |
| mAb14287 | 549 | 551 | 553 | 555 | 557 | 83 | 13 | 559 | 561 | 563 |
| mAb14288 | 565 | 567 | 569 | 571 | 573 | 575 | 577 | 579 | 581 | 583 |
| mAb14289 | 585 | 587 | 589 | 591 | 593 | 595 | 125 | 597 | 599 | 601 |
| mAb14290 | 603 | 605 | 607 | 609 | 611 | 613 | 125 | 615 | 617 | 619 |
| mAb14291 | 621 | 623 | 625 | 627 | 629 | 631 | 633 | 635 | 637 | 639 |
| mAb14292 | 641 | 643 | 645 | 647 | 649 | 651 | 653 | 654 | 656 | 658 |
| mAb14293 | 660 | 662 | 664 | 666 | 668 | 123 | 125 | 670 | 672 | 674 |
| mAb14295 | 676 | 678 | 680 | 681 | 683 | 685 | 125 | 687 | 689 | 691 |
| mAb13459 | 693 | 695 | 697 | 699 | 701 | 703 | 705 | 707 | 709 | 711 |
| mAb14230 | 713 | 695 | 715 | 717 | 719 | 721 | 125 | 723 | 725 | 727 |
| mAb14231 | 729 | 731 | 733 | 735 | 737 | 739 | 105 | 741 | 743 | 745 |
| mAb14232 | 747 | 749 | 496 | 751 | 753 | 755 | 504 | 757 | 759 | 761 |
| mAb14233 | 763 | 765 | 767 | 769 | 771 | 773 | 775 | 777 | 779 | 781 |
| mAb14234 | 783 | 785 | 787 | 789 | 791 | 793 | 795 | 797 | 799 | 801 |
| mAb14235 | 803 | 805 | 496 | 807 | 809 | 811 | 504 | 813 | 815 | 817 |
| mAb14247 | 819 | 821 | 823 | 824 | 826 | 755 | 13 | 828 | 830 | 832 |
| mAb14248 | 834 | 836 | 838 | 840 | 842 | 844 | 846 | 848 | 850 | 852 |
| mAb14249 | 854 | 856 | 858 | 860 | 862 | 864 | 105 | 866 | 868 | 870 |
| mAb14255 | 872 | 874 | 875 | 877 | 879 | 83 | 85 | 881 | 882 | 884 |
| mAb14256 | 886 | 888 | 890 | 892 | 894 | 896 | 163 | 898 | 900 | 902 |
| mAb14257 | 904 | 906 | 907 | 909 | 911 | 913 | 915 | 165 | 917 | 919 |
| mAb14258 | 921 | 923 | 925 | 927 | 929 | 931 | 932 | 934 | 936 | 938 |
| mAb14259 | 940 | 942 | 944 | 946 | 948 | 950 | 633 | 654 | 952 | 954 |
| mAb14260 | 956 | 958 | 960 | 962 | 964 | 966 | 968 | 970 | 972 | 974 |
| mAb13457 | 693 | 695 | 697 | 699 | 976 | 703 | 705 | 978 | 709 | 980 |
| mAb13458 | 693 | 695 | 697 | 699 | 982 | 703 | 705 | 984 | 709 | 986 |
| mAb14294 | 988 | 990 | 992 | 994 | 996 | 998 | 1000 | 1002 | 1004 | 1006 |
| mAb17090 | 492 | 494 | 496 | 498 | 500 | 502 | 504 | 506 | 1074 | 510 |
| mAb15160_2 | 361 | 363 | 365 | 367 | 369 | 371 | 105 | 373 | 1076 | 377 |

Antibodies disclosed herein have fully human variable regions but can have mouse constant regions (e.g., a mouse IgG1 Fc or a mouse IgG2 Fc (a or b isotype)) or human constant regions (e.g., a human IgG1 Fc or a human IgG4 Fc). As will be appreciated by a person of ordinary skill in the art, an antibody having a particular Fc isotype can be converted to an antibody with a different Fc isotype (e.g., an antibody with a mouse IgG1 Fc can be converted to an antibody with a human IgG4, etc.), but in any event, the variable domains (including the CDRs)—which are indicated by the numerical identifiers shown in Tables 4 and 5 will remain the same, and the binding properties to antigen are expected to be identical or substantially similar regardless of the nature of the constant domain.

As described above, the antibodies were obtained by direct isolation from antigen-positive VELOCIMMUNE® mouse B cells or derived from variable regions cloned from antigen-positive human B cells. A summary of these sources is shown in Table 6.

TABLE 6

Antibody/Variable Region sources

| mAb | Source |
| --- | --- |
| mAb13457 | mouse B cells |
| mAb13458 | mouse B cells |
| mAb13459 | mouse B cells |
| mAb14230 | human B cells |
| mAb14231 | human B cells |
| mAb14232 | human B cells |
| mAb14233 | human B cells |
| mAb14234 | human B cells |
| mAb14235 | human B cells |
| mAb14247 | human B cells |
| mAb14248 | human B cells |
| mAb14249 | human B cells |
| mAb14255 | mouse B cells |
| mAb14256 | mouse B cells |
| mAb14257 | mouse B cells |
| mAb14258 | mouse B cells |
| mAb14259 | human B cells |
| mAb14260 | mouse B cells |
| mAb14280 | human B cells |
| mAb14281 | human B cells |
| mAb14282 | human B cells |
| mAb14283 | human B cells |
| mAb14284 | human B cells |
| mAb14285 | human B cells |
| mAb14286 | human B cells |
| mAb14287 | human B cells |
| mAb14288 | human B cells |
| mAb14290 | human B cells |
| mAb14289 | human B cells |
| mAb14291 | human B cells |
| mAb14292 | human B cells |
| mAb14293 | human B cells |
| mAb14294 | human B cells |
| mAb14295 | human B cells |
| mAb14296 | human B cells |
| mAb14297 | human B cells |
| mAb14312 | mouse B cells |
| mAb14313 | mouse B cells |
| mAb14314 | mouse B cells |
| mAb14315 | human B cells |
| mAb14316 | human B cells |
| mAb15156 | mouse B cells |
| mAb15157 | mouse B cells |
| mAb15158 | human B cells |
| mAb15159 | human B cells |
| mAb15160 | human B cells |
| mAb15161 | human B cells |
| mAb15162 | human B cells |
| mAb15163 | human B cells |
| mAb15164 | human B cells |
| mAb15165 | human B cells |
| mAb15166 | human B cells |
| mAb15167 | human B cells |
| mAb15170 | human B cells |
| mAb15150 | human B cells |
| mAb15151 | human B cells |

Example 3: Biacore Binding Kinetics of Purified Anti-SARS-CoV-2-S Monoclonal Antibodies Equilibrium dissociation constant ($K_D$) for different SARS-COV-2 RBD reagents binding to purified CHOt anti-SARS-COV-2 monoclonal antibodies (mAbs) were determined using a real-time surface plasmon resonance based Biacore T200/ Biacore 8K biosensor. All binding studies were performed in 10 mM HEPES, 150 mM NaCl, 3 mM EDTA, and 0.05% v/v Surfactant Tween-20, pH 7.4 (HBS-ET) running buffer at 25° C. and 37° C. The Biacore CM5 sensor chip surface was first derivatized by amine coupling with either mouse anti-human Fc specific mAb (Regeneron, mAb2567) to capture anti-SARS-COV-2 mAbs. Binding studies were performed on human SARS-COV-2 RBD extracellular domain expressed with a C-terminal myc-myc-hexahistidine tag (SARS-COV-2 RBD-mmH) (monomeric RBD) (SEQ ID NO: 1069), SARS-COV-2 RBD extracellular domain expressed with a C-terminal mouse IgG2a Fc (SARS-COV-2 RBD mFc) (dimeric RBD) (SEQ ID NO: 1070), and SARS-CoV2 Spike ecto foldon Trimer expressed with a C-terminal myc-myc-hexahistidine (SARS-CoV2 Spike ECD foldon) (trimeric RBD). Use of these reagents allowed for the testing of the antibodies' ability to bind monomeric, dimeric, and trimeric RBD peptides, respectively.

Three concentrations, 50 nM, 12.5 nM and 3.12 nM, of hSARS-COV-2 RBD-mmH, SARS-COV-2 RBD mFc and SARS-CoV2 Spike ECD foldon prepared in HBS-ET running buffer, were injected for 1.5-3 minutes at a flow rate of 50 µL/min while the dissociation of mAb bound different SARS-COV-2 RBD reagents was monitored for 5-8 minutes in HBS-ET running buffer. At the end of each cycle, the SARS-COV-2 RBD mAb capture surface was regenerated using either 12 sec injection of 20 mM phosphoric acid for mouse anti-human Fc specific mAb surface. The association rate ($k_a$) and dissociation rate ($k_d$) were determined by fitting the real-time binding sensorgrams to a 1:1 binding model with mass transport limitation using BiaEvaluation software v3.1 or Biacore Insight Evaluation software v2.0. or curve-fitting software. Binding dissociation equilibrium constant ($K_D$) and dissociative half-life ($t\frac{1}{2}$) were calculated from the kinetic rates as:

$$K_D(M) = \frac{kd}{ka}, \text{ and } t^{1/2}(\min) = \frac{\ln(2)}{60*kd}$$

Binding kinetics parameters for different anti-SARS-COV-2 mAbs binding to monomeric, dimeric, and trimeric SARS-COV-2 RBD reagents of the invention at 25° C. and 37° C. are shown in Tables 7 through 12, respectively. An isotype control, mAb1932, was also used as a control.

TABLE 7

Kinetic Binding Parameters of the Interaction of Anti-SARS-COV-2 Monoclonal
Antibodies to Monomeric SARS-COV-2 RBD-mmH (SEQ ID NO: 1069) at 25° C.

| mAb Captured | mAb Capture Level (RU) | RBD monomer bound at 50 nM (RU) | $k_a$ (1/Ms) | $k_d$ (1/s) | KD (M) | t½ (min) |
|---|---|---|---|---|---|---|
| mAb14312 | 468.6 ± 4.6 | 190.8 | 1.53E+06 | 9.29E−04 | 6.06E−10 | 12.4 |
| mAb14260 | 415.3 ± 1.6 | 173.5 | 1.87E+06 | 1.38E−03 | 7.38E−10 | 8.4 |
| mAb14284 | 731.1 ± 1.2 | 236.5 | 6.66E+05 | 5.49E−04 | 8.24E−10 | 21.0 |
| mAb14258 | 423.9 ± 0.4 | 180.2 | 1.89E+06 | 1.61E−03 | 8.54E−10 | 7.2 |
| mAb14294 | 408.7 ± 2.0 | 138.3 | 6.00E+05 | 5.48E−04 | 9.14E−10 | 21.1 |
| mAb14283 | 410.1 ± 8.9 | 171.9 | 1.46E+06 | 1.58E−03 | 1.08E−09 | 7.3 |
| mAb14235 | 340.0 ± 4.0 | 117.1 | 7.89E+05 | 1.05E−03 | 1.33E−09 | 11.0 |
| mAb14289 | 395.1 ± 1.1 | 151 | 1.16E+06 | 1.58E−03 | 1.36E−09 | 7.3 |
| mAb13458 | 435.7 ± 4.4 | 158.4 | 9.09E+05 | 1.39E−03 | 1.53E−09 | 8.3 |
| mAb14313 | 532.2 ± 1.9 | 218.2 | 1.42E+06 | 2.17E−03 | 1.53E−09 | 5.3 |
| mAb14247 | 179.0 ± 0.5 | 63.3 | 8.38E+05 | 1.63E−03 | 1.94E−09 | 7.1 |
| mAb14315 | 465.8 ± 0.9 | 127.1 | 4.07E+05 | 1.02E−03 | 2.49E−09 | 11.4 |
| mAb13459 | 665.7 ± 4.5 | 219.3 | 6.93E+05 | 1.74E−03 | 2.51E−09 | 6.6 |
| mAb13457 | 412.5 ± 7.4 | 148.4 | 7.74E+05 | 2.05E−03 | 2.65E−09 | 5.6 |
| mAb14257 | 518.6 ± 1.0 | 215.1 | 3.40E+06 | 9.52E−03 | 2.80E−09 | 1.2 |
| mAb14255 | 432.4 ± 4.8 | 180.4 | 1.75E+06 | 4.99E−03 | 2.84E−09 | 2.3 |
| mAb14286 | 394.6 ± 5.2 | 158.5 | 3.23E+06 | 1.04E−02 | 3.22E−09 | 1.1 |
| mAb14282 | 414.4 ± 4.7 | 170.1 | 1.93E+06 | 9.57E−03 | 4.97E−09 | 1.2 |
| mAb14281 | 423.6 ± 0.4 | 157.8 | 1.10E+06 | 5.54E−03 | 5.02E−09 | 2.1 |
| mAb14230 | 315.0 ± 0.3 | 113.6 | 1.13E+06 | 8.52E−03 | 7.51E−09 | 1.4 |
| mAb14256 | 440.5 ± 3.6 | 175.4 | 1.11E+06 | 9.27E−03 | 8.32E−09 | 1.2 |
| mAb14285 | 443.1 ± 0.6 | 157.9 | 1.80E+06 | 2.11E−02 | 1.17E−08 | 0.5 |
| mAb14280 | 474.3 ± 0.5 | 177.3 | 1.66E+06 | 2.55E−02 | 1.54E−08 | 0.5 |
| mAb14234 | 458.8 ± 0.9 | 152.8 | 5.50E+05 | 1.13E−02 | 2.05E−08 | 1.0 |
| mAb14232 | 71.6 ± 1.4 | 18.8 | 1.12E+06 | 3.50E−02 | 3.12E−08 | 0.3 |
| mAb14292 | 431.3 ± 0.7 | 11.1 | 4.17E+05 | 1.71E−02 | 4.09E−08 | 0.7 |
| mAb14314 | 597.8 ± 0.8 | 11.6 | IC | IC | IC | IC |
| mAb14248 | 400.8 ± 1.6 | 269.5 | 7.06E+05 | 2.05E−05 | 2.90E−11 | 564.0 |
| mAb14295 | 441.5 ± 3.7 | 59.8 | 3.01E+05 | <1.00E−05 | 3.32E−11 | 21155.0 |
| mAb14233 | 492.8 ± 3.4 | 85.7 | 4.94E+05 | 3.6E−05 | 7.41E−11 | 315.5 |
| mAb14287 | 419.8 ± 0.3 | 91.9 | 3.10E+05 | 4.59E−05 | 1.48E−10 | 251.4 |
| mAb14293 | 432.5 ± 0.6 | 119.8 | 2.43E+05 | 8.10E−05 | 3.33E−10 | 142.6 |
| mAb14291 | 391.3 ± 3.3 | 47.8 | IC | IC | IC | IC |
| mAb14249 | 407.5 ± 1.0 | 42.3 | IC | IC | IC | IC |
| mAb14316 | 264.7 ± 1.6 | 40 | IC | IC | IC | IC |
| mAb14296 | 529.6 ± 0.7 | 32.3 | IC | IC | IC | IC |
| mAb14231 | 407.0 ± 2.2 | 27.3 | IC | IC | IC | IC |
| mAb14288 | 458.5 ± 2.3 | 24.7 | IC | IC | IC | IC |
| mAb14297 | 444.0 ± 1.4 | 13.7 | IC | IC | IC | IC |
| mAb14290 | 378.1 ± 1.2 | 12 | IC | IC | IC | IC |
| mAb14259 | 335.8 ± 2.8 | 7.8 | IC | IC | IC | IC |
| mAb15156 | 427.3 ± 17.1 | 91 | 2.89E+05 | 1.21E−03 | 4.18E−09 | 9.6 |
| mAb15157 | 291.6 ± 11.5 | 20.3 | 2.78E+05 | 1.25E−03 | 4.49E−09 | 9.3 |
| mAb15158 | 317.3 ± 6.6 | 26.3 | 1.04E+05 | 8.12E−05 | 7.79E−10 | 142.2 |
| mAb15159 | 286.3 ± 16.0 | 62 | 4.89E+04 | 1.30E−04 | 2.66E−09 | 88.8 |
| mAb15160 | 304.2 ± 8.3 | 9.3 | IC | IC | IC | IC |
| mAb15161 | 250.6 ± 15.3 | 40.3 | 1.73E+05 | 2.34E−04 | 1.35E−09 | 49.3 |
| mAb15162 | 287.1 ± 12.2 | 49.6 | 1.16E+05 | 8.50E−04 | 7.30E−09 | 13.6 |
| mAb15163 | 358.2 ± 12.8 | 51 | 2.18E+05 | 1.67E−05 | 7.79E−11 | 693.3 |
| mAb15164 | 315.8 ± 11.1 | 41.2 | 2.28E+05 | 3.49E−04 | 1.53E−09 | 33.1 |
| mAb15165 | 271.1 ± 13.8 | 33.9 | 5.39E+05 | 2.12E−04 | 3.93E−10 | 54.6 |
| mAb15166 | 249.2 ± 11.0 | 13.3 | 2.46E+05 | 5.35E−03 | 2.17E−08 | 2.2 |
| mAb15167 | 329.5 ± 10.9 | 21.8 | 2.65E+05 | 4.14E−03 | 1.56E−08 | 2.8 |
| mAb15170 | 278.8 ± 9.9 | 21.8 | 2.00E+05 | 1.53E−05 | 1.00E−10 | 756.4 |
| mAb15150 | 276.5 ± 9.6 | 33.3 | 7.74E+05 | 4.61E−05 | 5.94E−11 | 250.8 |
| mAb15151 | 354.8 ± 13.2 | 63.4 | 2.00E+05 | 7.78E−04 | 3.89E−09 | 14.8 |
| mAb1932 | 790.6 ± 9.6 | 0.6 | NB | NB | NB | NB |

NB: No binding (NB) was observed under the current experimental conditions.

IC: Observed binding did not fit to the binding simulation model and no binding kinetic parameters were determined under the current experimental conditions.

≤1.00E−05 indicates that no dissociation was observed under the current experimental conditions and the $k_d$ value was manually fixed at 1.00E−05 s$^{-1}$ while fitting the real time binding sensorgrams.

TABLE 8

Kinetic Binding Parameters of the Interaction of Anti-SARS-COV-2 Monoclonal Antibodies to Monomeric SARS-COV-2 RBD-mmH (SEQ ID NO: 1069) at 37° C.

| mAb Captured | mAb Capture Level (RU) | RBD monomer bound at 50 nM (RU) | $k_a$ (1/Ms) | $k_d$ (1/s) | KD (M) | t½ (min) |
|---|---|---|---|---|---|---|
| mAb14312 | 543 | 221.2 | 1.57E+06 | 9.88E−04 | 6.31E−10 | 11.7 |
| mAb14260 | 525.5 | 219.6 | 1.95E+06 | 1.44E−03 | 7.41E−10 | 8.0 |
| mAb14284 | 867.3 | 345.3 | 6.44E+05 | 6.05E−04 | 9.40E−10 | 19.1 |
| mAb14258 | 521 | 215.5 | 2.14E+06 | 1.70E−03 | 7.96E−10 | 6.8 |
| mAb14294 | 465.5 | 185.9 | 6.00E+05 | 5.90E−04 | 9.84E−10 | 19.6 |
| mAb14283 | 531.3 | 217.1 | 1.54E+06 | 1.79E−03 | 1.17E−09 | 6.4 |
| mAb14235 | 388.4 | 153.8 | 7.93E+05 | 1.09E−03 | 1.37E−09 | 10.6 |
| mAb14289 | 461.9 | 185.8 | 1.20E+06 | 1.76E−03 | 1.46E−09 | 6.5 |
| mAb13458 | 550.6 | 212.8 | 9.07E+05 | 1.39E−03 | 1.54E−09 | 8.3 |
| mAb14313 | 676 | 272.8 | 2.81E+06 | 2.59E−03 | 9.21E−10 | 4.5 |
| mAb14247 | 222.1 | 91.2 | 8.32E+05 | 1.63E−03 | 1.95E−09 | 7.1 |
| mAb14315 | 581.1 | 193 | 4.35E+05 | 9.85E−04 | 2.26E−09 | 11.7 |
| mAb13459 | 822.4 | 299 | 7.86E+05 | 2.04E−03 | 2.60E−09 | 5.7 |
| mAb13457 | 472.1 | 180.3 | 8.01E+05 | 2.34E−03 | 2.92E−09 | 4.9 |
| mAb14257 | 600.6 | 242.3 | 3.26E+06 | 7.62E−03 | 2.34E−09 | 1.5 |
| mAb14255 | 518.4 | 206 | 1.94E+06 | 5.35E−03 | 2.76E−09 | 2.2 |
| mAb14286 | 436.6 | 169.1 | 3.38E+06 | 1.04E−02 | 3.07E−09 | 1.1 |
| mAb14282 | 492.7 | 186.2 | 1.98E+06 | 1.06E−02 | 5.37E−09 | 1.1 |
| mAb14281 | 486.7 | 182 | 1.12E+06 | 5.82E−03 | 5.20E−09 | 2.0 |
| mAb14230 | 369.8 | 133.2 | 1.15E+06 | 8.76E−03 | 7.61E−09 | 1.3 |
| mAb14256 | 555.8 | 193.4 | 1.40E+06 | 1.15E−02 | 8.24E−09 | 1.0 |
| mAb14285 | 543.5 | 165.6 | 2.09E+06 | 2.74E−02 | 1.31E−08 | 0.4 |
| mAb14280 | 586 | 176.2 | 1.53E+06 | 2.48E−02 | 1.62E−08 | 0.5 |
| mAb14234 | 565.9 | 162 | 5.34E+05 | 1.19E−02 | 2.23E−08 | 1.0 |
| mAb14232 | 98.1 | 21.1 | 4.69E+06 | 3.72E−02 | 7.92E−09 | 0.3 |
| mAb14292 | 507.6 | 10.4 | 3.59E+05 | 2.18E−02 | 6.07E−08 | 0.5 |
| mAb14314 | 693.8 | 12.5 | 4.79E+05 | 1.15E−02 | 2.39E−08 | 1.0 |
| mAb14248 | 509.5 | 491.7 | 7.02E+05 | 1.90E−05 | 2.71E−11 | 607.3 |
| mAb14295 | 558.8 | 196.2 | 5.78E+05 | <1.00E−05 | 1.73E−11 | 21155.0 |
| mAb14233 | 561.8 | 276.8 | 3.20E+05 | 3.38E−05 | 1.06E−10 | 341.7 |
| mAb14287 | 528.8 | 154.9 | 7.04E+05 | 4.63E−05 | 6.58E−11 | 249.4 |
| mAb14293 | 531 | 166.7 | 9.62E+05 | 8.69E−05 | 9.03E−11 | 132.9 |
| mAb14291 | 516.4 | 224.5 | 3.08E+05 | 4.46E−05 | 1.45E−10 | 258.9 |
| mAb14249 | 482.5 | 143 | 2.38E+05 | 5.34E−05 | 2.25E−10 | 216.5 |
| mAb14316 | 304.6 | 132.1 | 8.05E+05 | <1.00E−05 | 1.24E−11 | 21155.0 |
| mAb14296 | 672.2 | 91.3 | 1.33E+05 | <1.00E−05 | 7.55E−11 | 21155.0 |
| mAb14231 | 490.1 | 54.7 | 3.18E+05 | 1.57E−04 | 4.94E−10 | 73.5 |
| mAb14288 | 576.6 | 72.9 | 1.06E+05 | 5.85E−05 | 5.54E−10 | 197.5 |
| mAb14297 | 529.3 | 32.1 | 3.01E+05 | 2.09E−04 | 6.94E−10 | 55.3 |
| mAb14290 | 457.9 | 32.9 | 2.34E+05 | 1.09E−05 | 4.66E−11 | 1057.7 |
| mAb14259 | 395.2 | 9 | NB | NB | NB | NB |
| mAb15156 | 463.2 ± 0.7 | 106.9 | 3.73E+05 | 5.35E−03 | 1.44E−08 | 2.2 |
| mAb15157 | 309.1 ± 1 | 65.7 | 3.44E+05 | 3.99E−03 | 1.16E−08 | 2.9 |
| mAb15158 | 298 ± 0.5 | 44.3 | 1.26E+05 | 2.07E−04 | 1.65E−09 | 55.7 |
| mAb15159 | 293.3 ± 1.9 | 42 | 1.46E+05 | 1.76E−04 | 1.21E−09 | 65.6 |
| mAb15160 | 400.6 ± 1.2 | 79.3 | 2.50E+05 | 1.94E−03 | 7.79E−09 | 5.9 |
| mAb15161 | 283.9 ± 0.9 | 61.1 | 2.63E+05 | 8.66E−04 | 3.29E−09 | 13.3 |
| mAb15162 | 322.4 ± 2.9 | 38.9 | 1.03E+05 | 2.99E−03 | 2.92E−08 | 3.9 |
| mAb15163 | 343.6 ± 1.7 | 72.7 | 2.18E+05 | 3.87E−04 | 1.78E−09 | 29.9 |
| mAb15164 | 385 ± 1.1 | 93.4 | 2.83E+05 | 1.79E−03 | 6.33E−09 | 6.5 |
| mAb15165 | 276.1 ± 2.3 | 82.5 | 4.75E+05 | 1.47E−03 | 3.10E−09 | 7.9 |
| mAb15166 | 266.8 ± 0.3 | 19.7 | 3.50E+05 | 3.34E−02 | 9.53E−08 | 0.3 |
| mAb15167 | 405.3 ± 0.6 | 46.8 | 3.52E+05 | 1.95E−02 | 5.55E−08 | 0.6 |
| mAb15170 | 299.4 ± 1.4 | 56.3 | 2.83E+05 | 8.36E−05 | 2.97E−10 | 138.1 |
| mAb15150 | 248.5 ± 1.2 | 64.9 | 4.93E+05 | 7.84E−05 | 1.58E−10 | 147.4 |
| mAb15151 | 595.8 ± 1.6 | 141.4 | 1.80E+05 | 4.42E−03 | 2.46E−08 | 2.6 |
| mAb1932 | 921.8 ± 2 | 1.3 | NB | NB | NB | NB |

NB: No binding (NB) was observed under the current experimental conditions.

IC: Observed binding did not fit to the binding simulation model and no binding kinetic parameters were determined under the current experimental conditions.

≤1.00E−05 indicates that no dissociation was observed under the current experimental conditions and the $k_d$ value was manually fixed at 1.00E−05 s$^{-1}$ while fitting the real time binding sensorgrams.

TABLE 9

Kinetic Binding Parameters of the Interaction of Anti-SARS-COV-2 Monoclonal Antibodies to Dimeric SARS-COV-2 RBD mFc (SEQ ID NO: 1070) at 25° C.

| mAb Captured | mAb Capture Level (RU) | RBD mFc dimer bound at 50 nM | $k_a$ (1/Ms) | $k_d$ (1/s) | KD (M) | t½ (min) |
|---|---|---|---|---|---|---|
| mAb14312 | 465.2 ± 3.8 | 349.2 | 1.68E+06 | 5.60E−05 | 3.34E−11 | 206.4 |
| mAb14260 | 416.5 ± 2.2 | 327.4 | 1.96E+06 | 8.70E−05 | 4.43E−11 | 132.8 |
| mAb14284 | 732.9 ± 0.5 | 482.2 | 8.31E+05 | 2.12E−05 | 2.55E−11 | 544.6 |
| mAb14258 | 420.7 ± 1 | 332.8 | 3.56E+04 | 1.09E−04 | 3.04E−09 | 106.5 |
| mAb14294 | 404.3 ± 5.6 | 291.4 | 9.11E+05 | 2.68E−05 | 2.94E−11 | 430.3 |
| mAb14283 | 417.5 ± 0.6 | 319.6 | 1.55E+06 | 8.14E−05 | 5.24E−11 | 141.9 |
| mAb14235 | 338.6 ± 2.2 | 242.7 | 1.10E+06 | 6.89E−05 | 6.27E−11 | 167.6 |
| mAb14289 | 393.3 ± 2.8 | 295.3 | 1.43E+06 | 8.95E−05 | 6.28E−11 | 129.1 |
| mAb13458 | 439.8 ± 2.5 | 326.7 | 1.18E+06 | 7.55E−05 | 6.40E−11 | 153.1 |
| mAb14313 | 528.5 ± 10.9 | 407.4 | 2.36E+06 | 9.97E−05 | 4.22E−11 | 115.9 |
| mAb14247 | 177.9 ± 0.7 | 135.5 | 1.19E+06 | 1.56E−04 | 1.31E−10 | 73.9 |
| mAb14315 | 455.9 ± 5.0 | 303.7 | 7.99E+05 | 6.26E−05 | 7.84E−11 | 184.4 |
| mAb13457 | 410.1 ± 7 | 308.2 | 1.33E+06 | 8.59E−05 | 6.45E−11 | 134.5 |
| mAb14257 | 519.6 ± 2.1 | 403.1 | 2.81E+06 | 2.54E−04 | 9.07E−11 | 45.4 |
| mAb14255 | 437.3 ± 0.4 | 340.7 | 2.19E+06 | 1.59E−04 | 7.26E−11 | 72.6 |
| mAb14286 | 393.5 ± 1.5 | 296.8 | 2.95E+06 | 6.55E−04 | 2.22E−10 | 17.6 |
| mAb14282 | 418.3 ± 0.9 | 326.3 | 2.17E+06 | 4.03E−04 | 1.86E−10 | 28.7 |
| mAb14281 | 424.2 ± 0.6 | 305.1 | 1.46E+06 | 2.13E−04 | 1.46E−10 | 54.3 |
| mAb14230 | 315.5 ± 0.6 | 240.6 | 2.00E+06 | 2.86E−04 | 1.42E−10 | 40.5 |
| mAb14256 | 440.9 ± 5.5 | 331.9 | 2.84E+06 | 1.81E−04 | 6.38E−11 | 63.7 |
| mAb14285 | 435.9 ± 1 | 318.7 | 5.78E+06 | 5.02E−04 | 8.68E−11 | 23 |
| mAb14280 | 476.4 ± 0.9 | 358.2 | 3.02E+06 | 3.70E−04 | 1.23E−10 | 31.2 |
| mAb14234 | 458.2 ± 5 | 328.7 | 1.02E+06 | 1.21E−04 | 1.19E−10 | 95.2 |
| mAb14232 | 71.7 ± 1.4 | 52.4 | 1.97E+06 | 1.73E−03 | 8.78E−10 | 6.7 |
| mAb14292 | 431.8 ± 1.4 | 76.8 | 1.04E+06 | 3.51E−02 | 3.36E−08 | 0.3 |
| mAb14314 | 601.8 ± 1.1 | 173.6 | 2.22E+06 | 5.60E−02 | 2.53E−08 | 0.2 |
| mAb14248 | 404.4 ± 1.8 | 4.9 | NB | NB | NB | NB |
| mAb14295 | 441.3 ± 4.7 | 8.4 | NB | NB | NB | NB |
| mAb14233 | 491.0 ± 2.3 | 2.3 | NB | NB | NB | NB |
| mAb14287 | 424.9 ± 3.8 | 9.4 | NB | NB | NB | NB |
| mAb14293 | 440.5 ± 0.3 | 5.8 | NB | NB | NB | NB |
| mAb14291 | 391.0 ± 4.3 | 3.3 | NB | NB | NB | NB |
| mAb14249 | 412.7 ± 1.1 | 4.6 | NB | NB | NB | NB |
| mAb14316 | 266.4 ± 1.7 | 11.4 | IC | IC | IC | IC |
| mAb14296 | 529.8 ± 1.7 | 4.6 | NB | NB | NB | NB |
| mAb14231 | 407.8 ± 1 | 4.8 | NB | NB | NB | NB |
| mAb14288 | 462.8 ± 1.2 | 4 | NB | NB | NB | NB |
| mAb14297 | 443.5 ± 1.2 | 6.8 | NB | NB | NB | NB |
| mAb14290 | 382.1 ± 3.6 | 7.7 | NB | NB | NB | NB |
| mAb14259 | 339.7 ± 0.5 | 8.3 | NB | NB | NB | NB |
| mAb15156 | 914.2 ± 2.1 | 493.4 | 1.41E+06 | 5.22E−05 | 3.69E−11 | 221.2 |
| mAb15157 | 543.7 ± 0.5 | 294.3 | 3.57E+05 | 6.67E−05 | 1.87E−10 | 173.2 |
| mAb15158 | 573.9 ± 1.8 | 175.4 | 4.53E+05 | 1.00E−05 | 2.21E−11 | 1,155.0 |
| mAb15159 | 519.6 ± 0.8 | 224.5 | 6.91E+05 | 1.19E−05 | 1.72E−11 | 971.4 |
| mAb15160 | 610.1 ± 1.6 | 268.3 | 2.58E+05 | 1.05E−05 | 4.06E−11 | 1,101.0 |
| mAb15161 | 547.4 ± 0.5 | 328.4 | 1.06E+06 | 1.26E−05 | 1.19E−11 | 913.8 |
| mAb15162 | 771.1 ± 0.3 | 354.1 | 1.29E+06 | 2.30E−04 | 1.79E−10 | 50.2 |
| mAb15163 | 529.5 ± 1.1 | 164.2 | 9.30E+05 | 1.00E−05 | 1.08E−11 | 1,155.0 |
| mAb15164 | 719.6 ± 0.5 | 308.8 | 3.72E+05 | 2.12E−05 | 5.69E−11 | 545.6 |
| mAb15165 | 644.5 ± 6.2 | 222.6 | 3.01E+05 | 3.88E+05 | 1.29E−10 | 297.5 |
| mAb15166 | 715.6 ± 4.0 | 334.4 | 1.02E+06 | 1.62E−05 | 1.60E−11 | 713.0 |
| mAb15167 | 501.7 ± 2.5 | 241.5 | 4.81E+05 | 1.05E−04 | 2.17E−10 | 110.3 |
| mAb15170 | 608.7 ± 2.3 | 237.5 | 3.39E+05 | 1.00E−05 | 2.95E−11 | 1,155.0 |
| mAb15151 | 1143 ± 2.6 | 491.7 | 9.24E+06 | 3.12E−05 | 3.38E−12 | 369.7 |
| mAb1932 | 1175.9 ± 2.3 | 6.8 | NB | NB | NB | NB |

NB: No binding (NB) was observed under the current experimental conditions.

IC: Observed binding did not fit to the binding simulation model and no binding kinetic parameters were determined under the current experimental conditions.

TABLE 10

Kinetic Binding Parameters of the Interaction of Anti-SARS-COV-2 Monoclonal Antibodies to dimeric SARS-COV-2 RBD mFc (SEQ ID NO: 1070) at 37° C..

| mAb Captured | mAb Capture Level (RU) | RBD mFc dimer bound at 50 nM | $k_a$ (1/Ms) | $k_d$ (1/s) | KD (M) | t½ (min) |
|---|---|---|---|---|---|---|
| mAb14312 | 550.3 | 422.3 | 1.67E+06 | 5.80E−05 | 3.47E−11 | 199.1 |
| mAb14260 | 521.7 | 408.3 | 1.93E+06 | 1.04E−04 | 5.40E−11 | 110.6 |
| mAb14284 | 872 | 659.3 | 8.30E+05 | 2.24E−05 | 2.70E−11 | 516.1 |
| mAb14258 | 271.5 | 392.5 | IC | IC | IC | IC |
| mAb14294 | 467.7 | 370.4 | 9.06E+05 | 3.50E−05 | 3.86E−11 | 330.1 |
| mAb14283 | 534.6 | 414.9 | 1.52E+06 | 9.59E−05 | 6.31E−11 | 120.5 |
| mAb14235 | 393.8 | 308.2 | 1.09E+06 | 6.68E−05 | 6.12E−11 | 173 |
| mAb14289 | 467.8 | 372.3 | 1.41E+06 | 1.28E−04 | 9.07E−11 | 90.1 |
| mAb13458 | 548.4 | 425.4 | 1.16E+06 | 9.12E−05 | 7.84E−11 | 126.7 |
| mAb14313 | 703.3 | 538 | 2.52E+06 | 1.46E−04 | 5.82E−11 | 78.9 |
| mAb14247 | 223 | 191.8 | 1.18E+06 | 1.50E−04 | 1.27E−10 | 77 |
| mAb14315 | 577.7 | 416.2 | 8.77E+05 | 7.91E−05 | 9.03E−11 | 145.9 |
| mAb13459 | 830 | 613.1 | 9.85E+05 | 9.24E−05 | 9.39E−11 | 125 |
| mAb13457 | 467.7 | 357.9 | 1.26E+06 | 1.17E−04 | 9.35E−11 | 98.5 |
| mAb14257 | 597.6 | 482 | 2.81E+06 | 3.39E−04 | 1.21E−10 | 34.1 |
| mAb14255 | 523 | 407.4 | 2.12E+06 | 2.50E−04 | 1.18E−10 | 46.2 |
| mAb14286 | 433.2 | 336.7 | 2.94E+06 | 5.28E−04 | 1.80E−10 | 21.9 |
| mAb14282 | 493.7 | 393.8 | 2.21E+06 | 5.46E−04 | 2.47E−10 | 21.1 |
| mAb14281 | 481.8 | 370.1 | 1.34E+06 | 3.65E−04 | 2.71E−10 | 31.7 |
| mAb14230 | 374 | 294.6 | 1.82E+06 | 4.90E−04 | 2.68E−10 | 23.6 |
| mAb14256 | 573.9 | 430.4 | 1.78E+06 | 4.73E−04 | 2.67E−10 | 24.4 |
| mAb14285 | 537 | 386.8 | 4.45E+06 | 1.03E−03 | 2.31E−10 | 11.2 |
| mAb14280 | 589.2 | 444.9 | 2.92E+06 | 7.72E−04 | 2.64E−10 | 15 |
| mAb14234 | 571.3 | 414.8 | 9.80E+05 | 4.02E−04 | 4.10E−10 | 28.8 |
| mAb14232 | 103.7 | 69 | 2.10E+06 | 1.88E−03 | 8.93E−10 | 6.1 |
| mAb14292 | 503.4 | 97.9 | 1.86E+06 | 6.44E−02 | 3.46E−08 | 0.2 |
| mAb14314 | 700.2 | 167.3 | 1.48E+06 | 3.57E−02 | 2.41E−08 | 0.3 |
| mAb14248 | 506.9 | 8.1 | NB | NB | NB | NB |
| mAb14295 | 555.3 | 13.8 | NB | NB | NB | NB |
| mAb14233 | 559.6 | 3.9 | NB | NB | NB | NB |
| mAb14287 | 528.2 | 19.8 | NB | NB | NB | NB |
| mAb14293 | 532.7 | 9.1 | NB | NB | NB | NB |
| mAb14291 | 529.1 | 6.1 | NB | NB | NB | NB |
| mAb14249 | 481 | 6.6 | NB | NB | NB | NB |
| mAb14316 | 303.8 | 14.5 | NB | NB | NB | NB |
| mAb14296 | 667.7 | 7.6 | NB | NB | NB | NB |
| mAb14231 | 494.9 | 8 | NB | NB | NB | NB |
| mAb14288 | 572.7 | 8.4 | NB | NB | NB | NB |
| mAb14297 | 525.8 | 12.4 | NB | NB | NB | NB |
| mAb14290 | 450.6 | 10.3 | NB | NB | NB | NB |
| mAb14259 | 395.4 | 9.4 | NB | NB | NB | NB |
| mAb15156 | 1206.3 ± 2.9 | 672.7 | 1.78E+05 | 1.12E−04 | 6.30E−10 | 103.2 |
| mAb15157 | 689.3 ± 1.8 | 411.9 | 9.22E+05 | 1.07E−04 | 1.16E−10 | 107.9 |
| mAb15158 | 699.6 ± 1.7 | 279.4 | 1.71E+05 | 2.90E−05 | 1.70E−10 | 398.3 |
| mAb15159 | 756.1 ± 1.1 | 314.8 | 2.20E+05 | 2.99E−05 | 1.35E−10 | 386.3 |
| mAb15160 | 913.9 ± 1.3 | 440.3 | 4.36E+05 | 7.90E−05 | 1.81E−10 | 146.2 |
| mAb15161 | 674.7 ± 0.6 | 352.5 | 1.05E+06 | 4.90E−05 | 4.69E−11 | 235.7 |
| mAb15162 | 835.4 ± 2.9 | 322.7 | 2.00E+05 | 1.01E−04 | 5.00E−10 | 114.8 |
| mAb15163 | 778.3 ± 3.3 | 407 | 4.16E+05 | 2.50E−05 | 6.01E−11 | 462.0 |
| mAb15164 | 937.9 ± 2.2 | 466.3 | 1.82E+06 | 9.40E−05 | 5.18E−11 | 122.9 |
| mAb15165 | 716.1 ± 0 | 191.1 | 1.00E+05 | 4.55E−05 | 4.50E−10 | 254.0 |
| mAb15166 | 616.1 ± 2.1 | 350.6 | 7.81E+05 | 9.80E−05 | 1.26E−10 | 117.9 |
| mAb15167 | 993.3 ± 3.2 | 499.8 | 1.40E+06 | 1.24E−04 | 8.90E−11 | 93.1 |
| mAb15170 | 779.1 ± 2.9 | 374.2 | 2.60E+05 | 2.41E−05 | 9.10E−11 | 480.0 |
| mAb15150 | 554 ± 1.8 | 338.7 | 9.46E+05 | 2.80E−05 | 2.96E−11 | 412.5 |
| mAb15151 | 1452 ± 4.1 | 653.6 | 3.70E+06 | 3.10E−03 | 8.50E−10 | 3.7 |
| mAb1932 | 2129.7 ± 4 | 20.6 | NB | NB | NB | NB |

NB: No binding (NB) was observed under the current experimental conditions.

IC: Observed binding did not fit to the binding simulation model and no binding kinetic parameters were determined under the current experimental conditions.

TABLE 11

Kinetic Binding Parameters of the Interaction of Anti-SARS-COV-2 Monoclonal Antibodies to Trimeric SARS-CoV2 Spike ECD foldon Fusion Protein at 25° C..

| mAb Captured | mAb Capture Level (RU) | Spike trimer.his bound at 50 nM | $k_a$ (1/Ms) | $k_d$ (1/s) | KD (M) | $t^{1/2}$ (min) |
|---|---|---|---|---|---|---|
| mAb14312 | 463.3 ± 4.0 | 393.4 | 1.93E+06 | 5.24E−05 | 2.72E−11 | 220.5 |
| mAb14260 | 411.6 ± 6.6 | 378.1 | 1.52E+06 | 5.87E−05 | 3.86E−11 | 196.6 |
| mAb14284 | 729.9 ± 1.8 | 469.4 | 8.12E+05 | 1.31E−05 | 1.61E−11 | 883 |
| mAb14425 8 | 420 ± 1.7 | 406.3 | 2.12E+06 | 4.91E−05 | 2.32E−11 | 235.3 |
| mAb14294 | 400.7 ± 3.8 | 341.7 | 6.97E+05 | 2.29E−05 | 3.29E−11 | 503.7 |
| mAb14283 | 417.4 ± 5.5 | 352.5 | 1.61E+06 | 8.66E−05 | 5.39E−11 | 133.3 |
| mAb14423 5 | 336.9 ± 1.2 | 297.5 | 7.79E+05 | 3.69E−05 | 4.74E−11 | 312.9 |
| mAb14289 | 387.0 ± 3.9 | 345.3 | 9.12E+05 | 6.35E−05 | 6.96E−11 | 182 |
| mAb13458 | 436.2 ± 3.7 | 340.8 | 1.21E+06 | 4.26E−05 | 3.51E−11 | 271.3 |
| mAb14313 | 528.7 ± 2.2 | 462 | 2.00E+06 | 1.13E−04 | 5.65E−11 | 102.1 |
| mAb14247 | 172 ± 4.9 | 143.3 | 9.44E+05 | 4.91E−05 | 5.21E−11 | 235 |
| mAb14315 | 458.4 ± 1.1 | 335.4 | 6.52E+05 | 3.15E−05 | 4.83E−11 | 366.2 |
| mAb13459 | 668.9 ± 8.1 | 483.2 | 1.41E+06 | 5.46E−05 | 3.89E−11 | 211.5 |
| mAb13457 | 405.4 ± 4.6 | 358.2 | 7.68E+05 | 5.52E−05 | 7.18E−11 | 209.2 |
| mAb14257 | 518.4 ± 1.3 | 535.3 | 2.45E+06 | 1.07E−04 | 4.34E−11 | 108.5 |
| mAb14255 | 431.9 ± 3.2 | 454.1 | 1.96E+06 | 1.38E−04 | 7.06E−11 | 83.5 |
| mAb14286 | 389.5 ± 2.0 | 425 | 2.63E+06 | 8.71E−05 | 3.31E−11 | 132.6 |
| mAb14282 | 413.2 ± 3.4 | 421.7 | 2.14E+06 | 1.33E−04 | 6.24E−11 | 86.6 |
| mAb14281 | 415 ± 5.6 | 310.7 | 8.34E+05 | 8.09E−05 | 9.70E−11 | 142.8 |
| mAb14230 | 313.1 ± 2.6 | 340 | 1.51E+06 | 6.09E−05 | 4.04E−11 | 189.8 |
| mAb14256 | 441.9 ± 6.3 | 356.7 | 1.47E+06 | 1.89E−04 | 1.29E−10 | 61 |
| mAb14285 | 435.7 ± 1.6 | 486.2 | 2.34E+06 | 3.98E−05 | 1.70E−11 | 290.4 |
| mAb14280 | 472.8 ± 1.3 | 458.7 | 1.99E+06 | 2.69E−05 | 1.36E−11 | 428.7 |
| mAb14234 | 455.7 ± 5.8 | 365.5 | 7.07E+05 | 5.48E−05 | 7.75E−11 | 210.7 |
| mAb14232 | 69.7 ± 1 | 72.8 | 7.63E+05 | 1.49E−04 | 1.95E−10 | 77.7 |
| mAb14292 | 429.2 ± 0.5 | 138.4 | 5.84E+05 | 4.21E−03 | 7.21E−09 | 2.7 |
| mAb14314 | 600.4 ± 1.7 | 184 | 4.92E+05 | 4.21E−03 | 8.56E−09 | 2.7 |
| mAb14248 | 403.3 ± 0.4 | 1.4 | NB | NB | NB | NB |
| mAb14295 | 446.7 ± 2.3 | 2.4 | NB | NB | NB | NB |
| mAb14233 | 488.5 ± 2.0 | 0.3 | NB | NB | NB | NB |
| mAb14287 | 421.9 ± 3.0 | 0.9 | NB | NB | NB | NB |
| mAb14293 | 448.8 ± 0.4 | 2.4 | NB | NB | NB | NB |
| mAb14291 | 396.1 ± 4.2 | 0.3 | NB | NB | NB | NB |
| mAb14249 | 413.5 ± 1.6 | −0.1 | NB | NB | NB | NB |
| mAb14316 | 269.1 ± 1.4 | 3.9 | NB | NB | NB | NB |
| mAb14296 | 528.3 ± 1.5 | 1.1 | NB | NB | NB | NB |
| mAb14231 | 410.9 ± 1.7 | 0.2 | NB | NB | NB | NB |
| mAb14288 | 459.0 ± 0.8 | 1.9 | NB | NB | NB | NB |
| mAb14297 | 451.0 ± 0.8 | 1.4 | NB | NB | NB | NB |
| mAb14290 | 379.4 ± 6.1 | 3.8 | NB | NB | NB | NB |
| mAb14259 | 340.6 ± 0.2 | 1.9 | NB | NB | NB | NB |
| mAb15156 | 447.5 ± 29.5 | 204.7 | 3.42E+05 | 6.61E−05 | 1.93E−10 | 174.6 |
| mAb15157 | 303.7 ± 13.3 | 42.5 | 3.02E+05 | 9.28E−05 | 3.08E−10 | 124.5 |
| mAb15158 | 328.2 ± 11.9 | 55.1 | 9.15E+04 | 1.40E−05 | 1.53E−10 | 825.0 |
| mAb15159 | 307.7 ± 25.7 | 147.1 | 8.75E+04 | 2.02E−05 | 2.31E−10 | 571.5 |
| mAb15160 | 318.2 ± 10.2 | 55.8 | 3.04E+05 | 3.10E−05 | 1.02E−10 | 372.6 |
| mAb15161 | 272 ± 25.5 | 127 | 2.80E+05 | 1.38E−05 | 4.90E−11 | 840.0 |
| mAb15162 | 303.6 ± 18 | 115.1 | 1.05E+05 | 6.79E−05 | 6.48E−10 | 170.0 |
| mAb15163 | 373.8 ± 15.3 | 97.6 | 2.14E+05 | 1.15E−05 | 5.62E−11 | 1,002.6 |
| mAb15164 | 331.2 ± 15.7 | 107.4 | 2.98E+05 | 2.58E−05 | 8.65E−11 | 448.0 |
| mAb15165 | 286.2 ± 19.5 | 103.9 | 3.91E+05 | 1.09E−05 | 2.79E−11 | 1,058.7 |
| mAb15166 | 264.4 ± 15.1 | 87 | 2.76E+05 | 1.74E−04 | 6.30E−10 | 66.3 |
| mAb15167 | 348.2 ± 20.2 | 114.1 | 3.36E+05 | 1.59E−04 | 4.72E−10 | 72.8 |
| mAb15170 | 290 ± 10.6 | 48.4 | 1.20E+05 | 1.29E−05 | 1.10E−10 | 893.3 |
| mAb15150 | 290.2 ± 16 | 87.6 | 3.17E+05 | 1.00E−05 | 3.15E−11 | 1,155.0 |
| mAb15151 | 375.4 ± 21.7 | 144.9 | 3.35E+05 | 6.26E−05 | 1.87E−10 | 184.5 |
| mAb1932 | 806.9 ± 10.9 | 2.6 | NB | NB | NB | NB |

NB: No binding (NB) was observed under the current experimental conditions.

IC: Observed binding did not fit to the binding simulation model and no binding kinetic parameters were determined under the current experimental conditions.

TABLE 12

Kinetic Binding Parameters of the Interaction of Anti-SARS-COV-2 Monoclonal Antibodies to Trimeric SARS-CoV2 Spike ECD foldon Fusion Protein at 37° C.

| Mab Captured | mAb Capture Level (RU) | Spike trimer.his bound at 50 nM | $k_a$ (1/Ms) | $k_d$ (1/s) | KD (M) | t½ (min) |
|---|---|---|---|---|---|---|
| mAb14312 | 541.7 | 500 | 9.66E+05 | 5.44E−05 | 5.63E−11 | 212.4 |
| mAb14260 | 519.4 | 495.3 | 9.49E+05 | 5.73E−05 | 6.04E−11 | 201.5 |
| mAb14284 | 865.5 | 631.1 | 8.14E+05 | 2.05E−05 | 2.51E−11 | 564.8 |
| mAb14258 | 518 | 523.9 | 1.02E+06 | 7.93E−05 | 7.76E−11 | 145.7 |
| mAb14294 | 463.8 | 440.6 | 6.94E+05 | 2.29E−05 | 3.30E−11 | 503.9 |
| mAb14283 | 535.5 | 470 | 8.65E+05 | 7.32E−05 | 8.47E−11 | 157.8 |
| mAb14235 | 386.4 | 396.9 | 7.35E+05 | 3.80E−05 | 5.17E−11 | 304 |
| mAb14289 | 463.7 | 455.7 | 9.11E+05 | 6.63E−05 | 7.28E−11 | 174.3 |
| mAb13458 | 548.9 | 466 | 8.15E+05 | 4.08E−05 | 5.00E−11 | 283.2 |
| mAb14313 | 687.8 | 610.7 | 1.01E+06 | 9.94E−05 | 9.84E−11 | 116.2 |
| mAb14247 | 221.2 | 247 | 6.74E+05 | 4.72E−05 | 7.01E−11 | 244.6 |
| mAb14315 | 576.2 | 457.2 | 7.43E+05 | 3.25E−05 | 4.37E−11 | 355.7 |
| mAb13459 | 826.8 | 632.1 | 7.94E+05 | 4.76E−05 | 5.99E−11 | 242.9 |
| mAb13457 | 468.9 | 452.4 | 7.67E+05 | 5.98E−05 | 7.79E−11 | 193.3 |
| mAb14257 | 602.9 | 684.6 | 1.17E+06 | 1.65E−04 | 1.41E−10 | 70.1 |
| mAb14255 | 516.8 | 575.4 | 1.03E+06 | 1.61E−04 | 1.55E−10 | 71.9 |
| mAb14286 | 437.5 | 539.2 | 2.59E+06 | 1.41E−04 | 5.44E−11 | 82 |
| mAb14282 | 497 | 566.5 | 1.05E+06 | 1.71E−04 | 1.62E−10 | 67.7 |
| mAb14281 | 488.8 | 429.8 | 8.34E+05 | 1.16E−04 | 1.39E−10 | 99.7 |
| mAb14230 | 372.3 | 435.6 | 9.06E+05 | 8.97E−05 | 9.91E−11 | 128.7 |
| mAb14256 | 570.7 | 509.1 | 7.96E+05 | 2.42E−04 | 3.04E−10 | 47.7 |
| mAb14285 | 533.8 | 647.3 | 1.16E+06 | 4.18E−05 | 3.59E−11 | 276.3 |
| mAb14280 | 594.3 | 650.1 | 9.85E+05 | 2.86E−05 | 2.90E−11 | 403.7 |
| mAb14234 | 564.5 | 473.8 | 6.99E+05 | 7.16E−05 | 1.02E−10 | 161.4 |
| mAb14232 | 104.1 | 119.6 | 7.51E+05 | 1.33E−04 | 1.77E−10 | 87.1 |
| mAb14292 | 504.7 | 236.7 | 5.92E+05 | 6.82E−03 | 1.15E−08 | 1.7 |
| mAb14314 | 697.7 | 259.4 | 4.59E+05 | 6.48E−03 | 1.41E−08 | 1.8 |
| mAb14248 | 505.9 | 2 | NB | NB | NB | NB |
| mAb14295 | 558.8 | 6.1 | NB | NB | NB | NB |
| mAb14233 | 558.6 | 1.5 | NB | NB | NB | NB |
| mAb14287 | 523.6 | 5.2 | NB | NB | NB | NB |
| mAb14293 | 537.9 | 3.5 | NB | NB | NB | NB |
| mAb14291 | 511.8 | 1.1 | NB | NB | NB | NB |
| mAb14249 | 478.6 | 2.7 | NB | NB | NB | NB |
| mAb14316 | 306.5 | 4.8 | NB | NB | NB | NB |
| mAb14296 | 660.5 | 2.5 | NB | NB | NB | NB |
| mAb14231 | 489.4 | 2 | NB | NB | NB | NB |
| mAb14288 | 571.6 | 2.9 | NB | NB | NB | NB |
| mAb14297 | 530.7 | 2.5 | NB | NB | NB | NB |
| mAb14290 | 457.4 | 4.3 | NB | NB | NB | NB |
| mAb14259 | 395.1 | 3 | NB | NB | NB | NB |
| mAb15156 | 463.7 ± 4.1 | 474.1 | 1.89E+06 | 2.12E−04 | 1.12E−10 | 54.5 |
| mAb15157 | 307.2 ± 1.0 | 298.2 | 1.70E+06 | 2.40E−04 | 1.41E−10 | 48.2 |
| mAb15158 | 295.7 ±1.3 | 224.5 | 7.58E+05 | 4.07E−05 | 5.41E−11 | 283.6 |
| mAb15159 | 293.3 ± 2.0 | 196.2 | 4.67E+05 | 3.22E−05 | 6.86E−11 | 359.1 |
| mAb15160 | 400.3 ± 1.4 | 301.9 | 1.26E+06 | 1.67E−04 | 1.32E−10 | 69.2 |
| mAb15161 | 283.7 ± 0.9 | 281.6 | 1.48E+06 | 9.14E−05 | 6.16E−11 | 126.4 |
| mAb15162 | 323.0 ± 1.5 | 205.5 | 4.40E+05 | 1.87E−04 | 4.25E−10 | 61.7 |
| mAb15163 | 343.6 ± 1.3 | 323.9 | 1.35E+06 | 4.85E−05 | 3.64E−11 | 238.1 |
| mAb15164 | 387.4 ± 1.5 | 379.2 | 1.78E+06 | 1.38E−04 | 7.77E−11 | 84.0 |
| mAb15165 | 279.2 ± 1.5 | 318.7 | 2.12E+06 | 1.15E−04 | 5.42E−11 | 100.2 |
| mAb15166 | 265.2 ± 0.5 | 282.8 | 1.54E+06 | 8.32E−05 | 5.40E−11 | 138.8 |
| mAb15167 | 406.6 ± 1.0 | 446.1 | 1.76E+06 | 9.78E−05 | 5.57E−11 | 118.1 |
| mAb15170 | 303.3 ± 1.4 | 221.3 | 8.46E+05 | 1.00E−05 | 1.18E−11 | 1,155.0 |
| mAb15150 | 249.8 ± 1.8 | 246.8 | 1.68E+06 | 3.42E−05 | 2.02E−11 | 337.6 |
| mAb15151 | 595.2 ± 0.8 | 372.7 | 1.92E+06 | 2.48E−04 | 1.29E−10 | 46.6 |
| mAb1932 | 926.9 ± 3.8 | 11.4 | NB | NB | NB | NB | hBST: human B-cell Sorting Technology
NB: No binding (NB) was observed under the current experimental conditions.
IC: Observed binding did not fit to the binding simulation model and no binding kinetic parameters were determined under the current experimental conditions.

Example 4: Neutralization of SARS-CoV-2 Wild-Type and Variant Spike Proteins

To test whether anti-SARS-CoV-2 spike protein antibodies can neutralize SARS-CoV-2 variants, these antibodies were screened against a panel of VSV pseudotype viruses expressing wild-type and variant spike proteins.

Generation of Recombinant VSV

Non-replicative pseudoparticles were generated using a VSV genome encoding the firefly luciferase and GFP genes instead of the native viral glycoprotein (VSV-G). Infectious particles complemented with VSV-G (VSV-ΔG-Fluc-2A-GFP/VSV-G) were recovered and produced using standard techniques with minor modifications. HEK293T cells (ATCC CRL-3216) were plated on poly-lysine treated plates and incubated overnight in DMEM without glutamine (Life Technologies), 10% fetal bovine serum (Life Technologies) and 1% Penicillin/Streptomycin/L-glutamine (Life Technologies). The following day, the cells were transfected with the VSV genomic clone driven by a T7 promoter and helper plasmids expressing the VSV-N, VSV-P, VSV-G, VSV-L, and T7 RNA polymerase with Lipofectamine LTX reagent (Life Technologies). After 48 hours, the transfected cells were co-cultured with BHK-21 cells (ATCC CCL-10) transfected with VSV-G using the SE cell Line 4D-Nucleofector X Kit L (Lonza) in DMEM without glutamine (Life Technologies), 3% fetal bovine serum (Life Technologies) and 1% Penicillin/Streptomycin/L-glutamine (Life Technologies). Cells were monitored for GFP expression or cytopathic effect (CPE) indicative of virus replication. Virus was then plaque purified, expanded, and titered in BHK-21 cells transiently expressing VSV-G. Fully replicative VSV-SARS-CoV-2-S virus was generated by replacing the VSV glycoprotein with the native SARS-CoV-2 sequences encoding residues 1-1255 of the spike protein (NCBI Accession No. MN908947.3). VSV-SARS-CoV-2-Spike virus was recovered as described above but the HEK293T cells were instead cocultured with BHK-21 cells transfected with both VSV-G and hACE2. VSV-SARS-CoV-2-S virus was plaque-purified and titered in Vero cells (ATCC CCL-81) and expanded in Vero E6 cells (ATCC CRL-1586). After collection, stocks of both viruses were centrifuged at 3000×g for 5 minutes to clarify, sucrose cushioned to concentrate 10-fold, aliquoted, and frozen at −80 C.

Pseudotyping of VSV

Non-replicative pseudoparticles were generated as previously described (Baum et al., Science 2020). Human codon-optimized SARS-CoV-2 spike (NCBI Accession No. MN908947.3) was cloned into an expression plasmid. A total of 1.2×107 HEK293T cells (ATCC CRL-3216) were seeded overnight in 15-cm dishes in DMEM without glutamine (Life Technologies) containing 10% heat-inactivated fetal bovine serum (Life Technologies), and Penicillin-Streptomycin-L-Glutamine (Life Technologies). The following day, the cells were transfected with 15 μg spike expression plasmid with Lipofectamine LTX (Life Technologies) following the manufacturer's protocol. At 24 hours post transfection, the cells were washed with phosphate buffered saline (PBS) and infected at a MOI of 1 with the VSV-ΔG-Fluc-2A-GFP/VSV-G virus diluted in 10 mL Opti-MEM (Life Technologies). The cells were incubated 1 hour at 37 C with 5% CO2. Cells were washed three times with PBS to remove residual input virus and overlaid with DMEM with glutamine (Life Technologies) with 0.7% IgG-free BSA (Sigma), sodium pyruvate (Life Technologies), and Gentamicin (Life Technologies). After 24 hours at 37° C. with 5% $CO_2$, the supernatant containing pseudoparticles was collected, centrifuged at 3000×g for 5 minutes to clarify, aliquoted, and frozen at −80° C. Variants were cloned into the spike expression plasmid using site-directed mutagenesis and pseudoparticles were produced as described above.

Neutralization Assays with VSV Based Pseudoparticles.

Vero cells (ATCC: CCL-81) were seeded in 96-well black, clear bottom tissue culture treated plated (Corning: 3904) at 20,000 cells/well in DMEM media without glutamine (Life Technologies) containing 10% heat-inactivated fetal bovine serum (Life Technologies), and 1× Penicillin/Streptomycin/L-Glutamine (Life Technologies) 24 hours prior to assay. Cells were allowed to reach approximately 85% confluence before use in assay. Antibodies were diluted in Infection Media containing DMEM with glutamine (Life Technologies), 0.7% Low IgG BSA (Sigma), 1× Sodium Pyruvate (Life Technologies), and 0.5% Gentamicin (Life Technologies) to 2× assay concentration and diluted 3-fold down in Infection media, for an 11-point dilution curve in the assay beginning at 3 μg/mL (20 nM). Antibody dilutions were mixed 1:1 with pseudoparticles for 30 minutes at room temperature prior to addition onto Vero cells. Cells were incubated at 37° C., 5% $CO_2$ for 24 hours. Supernatant was removed from cells prior to lysis with 100 μL Glo Lysis Buffer (Promega). 100 μL resuspended Bright Glo substrate (Promega) was then added and luminescence was read on a Spectramax i3x (Molecular Devices). Exported values were analyzed using GraphPad Prism (v8.4.1).

Individual monoclonal antibody half maximal inhibitory concentration (IC50) against VSV-SARS-CoV-2 spike protein (S)-expressing pseudovirus encoding the Wuhan-Hu-1 (NCBI Accession Number MN908947.3) sequence of spike protein (S-wt) or the D614G spike protein variant (SEQ ID NO: 1071) were determined in Vero cells (Table 13). The majority of antibodies displayed neutralization potency in the picomolar range (pM), with some exhibiting neutralization potency in nanomolar (nM) range, and some non-neutralizing. In addition, IC50s were measured for individual monoclonal antibodies tested against certain variant of concern/interest VSV-SARS-CoV-2 spike protein (S)-expressing pseudoviruses (Table 14), including the Omicron variant (individual mutations contained in Omicron in Table 15; complete set of Omicron mutations in Table 16, and comparison to and combination with mAb10933 and mAb10987 in Table 17). In the Omicron neutralization assay, mAb15160 was unaffected, while mAb14315 had a marginally decreased neutralization. Based on these results, a mAb14315/ mAb15160 combination and a mAb15160/mAb14256 combination maintain effective neutralization of the Omicron variant. In addition, mAb14284, mAb14235, and mAb14287 were potent neutralizers and were unaffected by the Omicron variants, while mAb15151 had a half-log decrease in neutralization of the Omicron variant but maintained potency nonetheless based on its strong neutralization properties. As shown in the tables, the lower the fold change from wt or D614G, the less impact the Omicron mutations have on neutralization. Additional mAb15160 and mAb14284 neutralization data is presented in Tables 18 and 19, showing that these antibodies are potent neutralizers of different variants, including Omicron lineages.

TABLE 13 mAb neutralization potency (IC50 (M)) against the wild-type or D614G strain of VSV-SARS-CoV-2-S pseudoparticles in Vero cells

| mAb | IC50 (M) |
| --- | --- |
| mAb13457 | 2.48E−11 |
| mAb13458 | 2.61E−11 |

TABLE 13-continued mAb neutralization potency (IC50 (M)) against the wild-type or D614G strain of VSV-SARS-CoV-2-S pseudoparticles in Vero cells

| mAb | IC50 (M) |
| --- | --- |
| mAb13459 | 3.66E−11 |
| mAb14230 | 2.41E−11 |
| mAb14231 | 1.02E−09 |
| mAb14232 | 6.35E−11 |
| mAb14233 | 5.42E−11 |
| mAb14234 | 3.98E−11 |
| mAb14235 | 3.38E−11 |
| mAb14247 | 5.80E−11 |
| mAb14248 | 6.20E−11 |
| mAb14249 | 1.62E−10 |
| mAb14255 | 3.43E−11 |
| mAb14256 | 5.47E−11 |
| mAb14257 | 2.91E−11 |
| mAb14258 | 5.57E−11 |
| mAb14259 | 3.72E−11 |
| mAb14260 | 9.28E−11 |
| mAb14280 | 2.86E−11 |
| mAb14281 | 3.35E−11 |
| mAb14282 | 3.27E−11 |
| mAb14283 | 5.49E−11 |
| mAb14284 | 3.14E−11 |
| mAb14285 | 3.25E−11 |
| mAb14286 | ~2.616E11 |
| mAb14287 | 1.99E−10 |
| mAb14288 | 1.38E−09 |
| mAb14289 | 4.02E−11 |
| mAb14290 | 1.20E−09 |
| mAb14291 | 1.23E−10 |
| mAb14292 | 5.77E−11 |
| mAb14293 | 1.10E−09 |
| mAb14294 | 5.67E−11 |
| mAb14295 | 1.95E−10 |
| mAb14296 | 5.26E−10 |
| mAb14297 | 3.85E−10 |
| mAb14312 | 4.66E−11 |
| mAb14313 | 2.72E−10 |
| mAb14314 | no activity |
| mAb14315 | 4.76E−11 |
| mAb14316 | 1.29E−10 |
| <u>mAb15156</u> | <u>2.09E−11</u> |
| <u>mAb15157</u> | <u>3.72E−11</u> |
| <u>mAb15158</u> | <u>1.24E−10</u> |
| <u>mAb15159</u> | <u>5.78E−11</u> |
| <u>mAb15160</u> | <u>4.58E−11</u> |
| <u>mAb15161</u> | <u>4.91E−11</u> |
| <u>mAb15162</u> | <u>1.11E−10</u> |
| <u>mAb15163</u> | <u>6.28E−11</u> |
| <u>mAb15164</u> | <u>2.48E−11</u> |
| <u>mAb15165</u> | <u>2.96E−11</u> |
| <u>mAb15166</u> | <u>1.61E−11</u> |
| <u>mAb15167</u> | <u>2.95E−11</u> |
| <u>mAb15170</u> | <u>1.22E−10</u> |
| <u>mAb15150</u> | <u>6.21E−11</u> |
| <u>mAb15151</u> | <u>7.09E−12</u> |

Underlined IC50 values determined using D614G spike protein.

TABLE 14

Pseudoparticle neutralization IC50 (M) of variants of concern/interest (VOCs/VOIs) variants in Vero cells

| | B.1.1.7 | | B.1.351 | | P.1 | | E484K | | L452R | |
| --- | --- | --- | --- | --- | --- | --- | --- | --- | --- | --- |
| mAb | IC50 | FC | IC50 | FC | IC50 | FC | IC50 | FC | IC50 | FC |
| mAb14255 | 1.8E−11 | 1.2 | 3.9E−11 | 1.9 | 4.1E−11 | 1.7 | 4.5E−11 | 2.8 | 2.9E−11 | 1.4 |
| mAb14256 | 4.3E−11 | 1.0 | 1.5E−11 | 0.4 | 1.3E−11 | 0.3 | 1.6E−11 | 0.8 | 2.8E−11 | 0.7 |
| mAb14257 | 1.1E−11 | 1.6 | 1.7E−08 | >48988 | ND | ND | NA | >2640 | ND | ND |
| mAb14258 | 1.0E−10 | 1.5 | NA | >1754 | ND | ND | NA | >794 | ND | ND |
| mAb14312 | ND | ND | 2.9E−10 | 9.3 | ND | ND | ND | ND | 7E−11 | 2.2 |
| mAb14315 | 8.0E−11 | 2.7 | 9.8E−12 | 0.3 | 4.1E−11 | 0.6 | 1.5E−11 | 0.5 | 4.2E−11 | 1.0 |
| mAb15156 | 3.1E−11 | 1.5 | 4.8E−12 | 0.2 | ND | ND | ND | ND | 3.7E−11 | 1.4 |
| mAb15157 | 5.7E−11 | 1.5 | 1.4E−11 | 0.4 | ND | ND | ND | ND | ND | ND |
| mAb15158 | 1.1E−10 | 0.9 | 2.1E−08 | 172 | ND | ND | ND | ND | ND | ND |
| mAb15159 | 7.7E−11 | 1.3 | 2.6E−11 | 0.5 | ND | ND | ND | ND | ND | ND |
| mAb15160 | 5.3E−11 | 1.2 | 1.1E−11 | 0.2 | ND | ND | ND | ND | 5.8E−11 | 1.6 |
| mAb15161 | 7.2E−11 | 1.5 | 1.5E−11 | 0.3 | ND | ND | ND | ND | 5.9E−11 | 1.1 |
| mAb15162 | 7.5E−11 | 0.7 | 4.2E−11 | 0.4 | ND | ND | ND | ND | ND | ND |
| mAb15163 | 6.5E−11 | 1.0 | 2.5E−10 | 4.0 | ND | ND | ND | ND | ND | ND |
| mAb15164 | 2.7E−11 | 1.1 | 2.6E−11 | 1.0 | ND | ND | ND | ND | 3.0E−11 | 2.0 |
| mAb15165 | 2.9E−11 | 1.0 | 1.6E−11 | 0.6 | ND | ND | ND | ND | 2.9E−11 | 2.2 |

TABLE 14-continued

Pseudoparticle neutralization IC50 (M) of variants of concern/interest (VOCs/VOIs) variants in Vero cells

| mAb | B.1.1.7 IC50 | FC | B.1.351 IC50 | FC | P.1 IC50 | FC | E484K IC50 | FC | L452R IC50 | FC |
|---|---|---|---|---|---|---|---|---|---|---|
| mAb 15166 | 2.4E−11 | 1.5 | 1.9E−10 | 12.0 | ND | ND | ND | ND | ND | ND |
| mAb 15167 | 2.9E−11 | 1.0 | 3.1E−10 | 10.4 | ND | ND | ND | ND | ND | ND |
| mAb 15170 | 9.5E−11 | 0.8 | 8.9E−11 | 0.7 | ND | ND | ND | ND | ND | ND |
| mAb 15150 | 8.3E−11 | 1.3 | 5.7E−12 | 0.1 | ND | ND | ND | ND | ND | ND |
| mAb 15151 | 1.1E−11 | 1.0 | 5.4E−12 | 0.8 | ND | ND | 2.3E−11 | 2.1 | 2E−11 | 0.9 |

Full B.1.1.7 (H69del, V70del, Y145del, N501Y, A570D, D614G, P681H, T716I, S982A, D1118H), B. 1.351 (D80Y, D215Y, L241del, L242del, A243del, L242del, K417N, E484K, N501Y, D614G, A701V), and P.1 (L18F, T20N, P26S, D138Y, R190S, K417T, E484K, N501Y, D614G, H655Y, T1027I, VI176F) variants were assessed. Key RBD residues from B.1.429 (L452R) and B. 1.526 (E484K) lineages were assessed.

Fold-decrease in potency (FC) was calculated relative to wt or D614G control from same assay

TABLE 15

Pseudoparticle neutralization IC50 (M) and fold-change of variants in Vero cells

| Spike protein | mAb14256 | mAb14315 | mAb15160 | mAb10985 |
|---|---|---|---|---|
| WT/D614G (IC50) | 2.606E−11 | 2.95E−11 | 4.58E−11 | 2.17E−10 |
| K417N (FC) | 1.46 | 0.66 | 0.86 | 1.38 |
| N440K (FC) | 2.51 | 0.94 | ND | 1.41 |
| S477N (FC) | 1.01 | 0.60 | 1.01 | 1.32 |
| T478K (FC) | 0.81 | 0.96 | 1.98 | 0.98 |
| Q493R (FC) | 0.86 | 0.45 | ND | 0.38 |
| N501Y (FC) | 1.06 | ND | 1.81 | 1.28 |

Italics: IC50 values for each antibody against wt or D614G control spike protein
Fold-decrease in potency (FC) was calculated relative to wt or D614G control from the same assay
ND: Not determined

TABLE 16

Pseudoparticle neutralization IC50 (M), IC90 (M), and IC50 fold-change of Omicron variant SARS-CoV-2 in Vero cells

| SARS-CoV-2 spike glycoprotein | mAb14256 | mAb14315 | mAb15160 | mAb15160 + mAb14315 | mAb14256 + mAb15160 |
|---|---|---|---|---|---|
| D614G (control) IC50 (IC90, where provided) | 5.33E−11 (4.08E−10) | 4.97E−11 | 2.95E−11 | 4.76E−11 | 4.84E−11 |
| Omicron IC50 (IC90, where provided) | NC (NC) | 1.45E−10 | 1.71E−11 | 6.47E−11 | 1.02E−10 |
| D614G (control) IC50 | 1.00 (0.00) | 1.00 (0.00) | 1.00 (0.00) | 1.00 (0.00) | 1.00 (0.00) |
| Omicron IC50 FC (log10 FC) | 375.38 (2.57) | 2.91 (0.46) | 0.58 (−0.24) | 1.36 (0.13) | 2.10 (0.32) |

| SARS-CoV-2 spike glycoprotein | mAb14284 | mAb14235 | mAb14294 | mAb14234 | mAb14312 |
|---|---|---|---|---|---|
| D614G (control) | 8.25E−12 | 3.79E−12 | 5.00E−12 | 2.38E−12 | 1.00E−12 |
| Omicron | 1.03E−11 | 6.84E−12 | 6.67E−12 | 2.62E−12 | 7.94E−13 |
| D614G (control) IC50 FC (log10 FC) | 1.00 (0.00) | 1.00 (0.00) | 1.00 (0.00) | 1.00 (0.00) | 1.00 (0.00) |
| Omicron IC50 FC (log10 FC) | 1.25 (0.00) | 1.81 (0.26) | 1418.80 (3.15) | 21.82 (1.34) | 5287.59 (3.72) |

| SARS-CoV-2 spike glycoprotein | mAb15170 | mAb15162 | mAb15150 | mAb15151 | mAb15159 | mAb15161 |
|---|---|---|---|---|---|---|
| D614G (control) | 6.41E−12 | 4.31E−12 | 8.52E−13 | 7.78E−13 | 4.34E−12 | 1.92E−12 |
| Omicron | 6.11E−12 | 7.25E−12 | 1.23E−12 | 2.44E−12 | 5.05E−12 | 1.08E−12 |
| D614G (control) IC50 FC (log10 FC) | 1.00 (0.00) | 1.00 (0.00) | 1.00 (0.00) | 1.00 (0.00) | 1.00 (0.00) | 1.00 (0.00) |
| Omicron IC50 FC (log10 FC) | 37.20 (1.57) | 27.88 (1.45) | 392.47 (2.59) | 3.14 (0.50) | 214.77 (2.33) | 160.43 (2.21) |

TABLE 16-continued

Pseudoparticle neutralization IC50 (M), IC90 (M), and IC50 fold-change of Omicron variant SARS-CoV-2 in Vero cells

| SARS-CoV-2 spike glycoprotein | mAb15157 | mAb15156 | mAb14287 | mAb14297 |
|---|---|---|---|---|
| D614G (control) | 1.01E−12 | 4.62E−13 | 2.18E−12 | 9.72E−12 |
| Omicron | 1.15E−12 | 4.96E−13 | 4.42E−12 | NC |
| D614G (control) IC50 FC (log10 FC) | 1.00 (0.00) | 1.00 (0.00) | 1.00 (0.00) | 1.00 (0.00) |
| Omicron IC50 FC (log10 FC) | 19841.27 (4.30) | 74.72 (1.87) | 0.20 (−0.69) | 2058.67 (3.31) |

Omicron spike protein used comprises SEQ ID NO: 1073 the following mutations: A67V, Δ69-70, T95I, G142D/Δ143-145, Δ211/L212I, ins214EPE, G339D, S371L, S373P, S375F, K417N, N440K, G446S, S477N, T478K, E484A, Q493R, N501Y, Y505H, T547K, D614G, H655Y, N679K, P681H, N764K, D796Y, N856K, Q954H, N969K, L981F
NC: No IC50 calculated due to no activity
FC: Fold change calculated relative to D614G control
Values in bold and underlined: Fold change is at least this value, calculated as highest assay concentration/D614G IC50; highest concentration in assay was 2.00E−08

TABLE 17

Pseudoparticle neutralization IC50 (M) and IC50 fold-change of Omicron variant (B.1.1.529/BA.1) SARS-CoV-2 in Vero cells

| | mAb10933 + mAb10987 | | mAb15160 | | mAb15160 + mAb10933 + mAb10987 2:1:1 (inferred values) | |
|---|---|---|---|---|---|---|
| Variant[a] | IC$_{50}$(M) | Fold Decrease in IC$_{50}$ over Ref Virus[b] | IC$_{50}$(M) | Fold Decrease in IC$_{50}$ over Ref Virus[b] | IC$_{50}$(M) | Fold Decrease in IC$_{50}$ over Ref Virus[b] |
| D614G control | 9.91E−12 | 1.0 | 1.92E−11 | 1.0 | 3.84E−11 | 1.0 |
| B.1.1.529/BA.1 (Omicron) | NC | >2018.98[c] | 3.18E−11 | 1.65 | 6.36E−11 | 3.3 |

[a]Amino acid substitutions versus Wuhan lineage S protein: B.1.1.529/BA.1 (A67V, del69-70, T95I, G142D/del143-145, del211/L212I, ins214EPE, G339D, S371L, S373P, S375F, K417N, N440K, G446S, S477N, T478K, E484A, Q493R, G496S, Q498R, N501Y, Y505H, T547K, D614G, H655Y, N679K, P681H, N764K, D796Y, N856K, Q954H, N969K, L981F)
[b]Fold decrease relative to reference (ref) D614G virus was calculated by dividing the IC$_{50}$ value generated by the antibody(ies) in the presence of a particular variant by the IC$_{50}$ value generated by the antibody(ies) in the presence of reference virus from the same assay.
[c]Where an IC$_{50}$ value could not be accurately calculated, the change in mAb potency in the presence of each mutant was calculated by dividing the maximum antibody concentration tested (20 nM) by the IC$_{50}$ value calculated for the reference D614G VLP. The actual fold change is at least that of the indicated value.
Abbreviations: NC, not calculated due to poor or lack of neutralization

TABLE 18

IC$_{50}$ and IC$_{90}$ Values for mAb15160-Mediated Neutralization of Entry of pVSV-Luc-SARS-CoV-2-S Pseudotyped with S Protein Variants into Vero Cells

| | mAb15160 | | | mAb10933 (Casirivimab) | | | mAb10987 (Imdevimab) | | | Casirivimab + Imdevimab | | |
|---|---|---|---|---|---|---|---|---|---|---|---|---|
| SARS-CoV-2 S Protein Variant | IC$_{50}$ [M] | IC$_{90}$ [M] | Fold Change in IC$_{50}$ over Ref Virus | IC$_{50}$ [M] | IC$_{90}$ [M] | Fold Change in IC$_{50}$ over Ref Virus | IC$_{50}$ [M] | IC$_{90}$ [M] | Fold Change in IC$_{50}$ over Ref Virus | IC$_{50}$ [M] | IC$_{90}$ [M] | Fold Change in IC$_{50}$ over Ref Virus |
| Full Sequences or Key Residues of Variants under Surveillance[a] and Other Multi-Variant Lineages | | | | | | | | | | | | |
| B.1.1.7 (Alpha) | 5.28E−11 | 2.21E−10 | 1.15 | 2.26E−11 | 2.23E−10 | 0.69 | 1.71E−11 | 9.31E−11 | 0.41 | 1.11E−11 | 9.09E−11 | 0.46 |
| B.1.351 (Beta) | 1.07E−11 | 1.70E−10 | 0.23 | 2.87E−09 | 2.68E−08 | 87.97 | 2.12E−11 | 4.43E−11 | 0.51 | 2.67E−11 | 2.54E−10 | 1.11 |
| P.1 (Gamma) | 1.02E−11 | 6.55E−11 | 0.48 | 7.52E−09 | 3.16E−07 | 167.54 | 4.58E−12 | 6.46E−11 | 0.18 | 1.01E−11 | 7.63E−11 | 1.16 |
| B.1.617.2 (Delta) | 2.80E−11 | 1.55E−10 | 3.07 | 4.32E−12 | 4.23E−11 | 0.55 | 1.04E−11 | 2.11E−10 | 1.26 | 7.45E−12 | 5.02E−11 | 1.06 |
| K417N + L452R + T478K (AY.1 [Delta]) | 5.61E−12 | 1.04E−10 | 0.16 | 1.81E−11 | 5.01E−10 | 1.23 | 8.08E−12 | 1.46E−10 | 0.58 | 7.50E−12 | 5.53E−11 | 0.55 |

TABLE 18-continued $IC_{50}$ and $IC_{90}$ Values for mAb15160-Mediated Neutralization of Entry of pVSV-Luc-SARS-CoV-2-S Pseudotyped with S Protein Variants into Vero Cells

| SARS-CoV-2 S Protein Variant | mAb15160 | | | mAb10933 (Casirivimab) | | | mAb10987 (Imdevimab) | | | Casirivimab + Imdevimab | | |
|---|---|---|---|---|---|---|---|---|---|---|---|---|
| | $IC_{50}$ [M] | $IC_{90}$ [M] | Fold Change in $IC_{50}$ over Ref Virus | $IC_{50}$ [M] | $IC_{90}$ [M] | Fold Change in $IC_{50}$ over Ref Virus | $IC_{50}$ [M] | $IC_{90}$ [M] | Fold Change in $IC_{50}$ over Ref Virus | $IC_{50}$ [M] | $IC_{90}$ [M] | Fold Change in $IC_{50}$ over Ref Virus |
| L145H + A222V + L452R + T478K (AY4.2 [Delta]) | 2.32E-11 | 1.82E-10 | 1.73 | 1.15E-11 | 8.27E-11 | 0.70 | 3.60E-11 | 6.57E-10 | 1.94 | 1.55E-11 | 7.38E-11 | 1.51 |
| L452R (B.1.427/B.1.429 [Epsilon]) | 5.83E-11 | 2.24E-10 | 1.55 | 5.60E-11 | 3.17E-10 | 0.76 | 7.83E-11 | 7.26E-10 | 1.03 | 4.96E-11 | 1.64E-10 | 1.15 |
| E484K [(B.1.526 [Iota])] | 5.97E-11 | 4.83E-10 | 2.84 | 2.49E-10 | 3.53E-09 | 5.55 | 2.62E-11 | 4.30E-10 | 1.01 | 3.20E-11 | 1.60E-10 | 3.67 |
| B.1.617.1 (Kappa) | 2.98E-11 | 1.76E-10 | 2.98 | 1.14E-10 | 1.06E-09 | 22.12 | 1.51E-11 | 1.63E-10 | 1.68 | 2.45E-11 | 9.08E-11 | 3.07 |
| F490S + L452Q (C.37 [Lambda]) | 2.64E-11 | 2.35E-10 | 0.73 | 1.37E-11 | 1.73E-10 | 0.93 | 4.23E-11 | 5.72E-10 | 3.05 | 1.53E-11 | 1.23E-10 | 1.12 |
| R346K + E484K + N501Y (B.1.621 [Mu]) | 2.52E-11 | 2.95E-10 | 1.71 | 2.10E-10 | 1.74E-09 | 19.22 | 9.03E-12 | 1.00E-10 | 0.60 | 1.44E-11 | 1.54E-10 | 1.29 |
| BA.1 (Omicron) | 1.84E-11 | 1.80E-10 | 1.05 | NC | NC | >1731.60[b] | NC | NC | >754.43[b] | NC | NC | >1012.66[b] |
| BA.1.1 (Omicron) | 2.26E-11 | 1.57E-10 | 0.96 | NC | NC | >1336.01[b] | NC | NC | >1108.65[b] | NC | NC | >1460.92[b] |
| BA.2 (Omicron) | 1.46E-11 | 1.53E-10 | 2.08 | 6.80E-09 | 8.04E-08 | 461.82 | 2.19E-09 | 1.99E-08 | 158.12 | 2.60E-09 | 1.82E-08 | 190.26 |
| BA.2.12.1 (Omicron) | 5.63E-11 | 4.67E-10 | 2.22 | NC | NC | >702.26 | 3.18E-09 | 1.79E-08 | 137.46 | 4.77E-09 | 1.71E-08 | 275.13 |
| BA.3 (Omicron) | 6.06E-11 | 1.16E-09 | 3.34 | NC | NC | 1258.65 | NC | NC | 899.69 | NC | NC | 1456.66 |
| BA.4/BA.5 (Omicron) | NC | NC | >701.48 | NC | NC | 652.76 | 1.38E-09 | 1.10E-08 | 54.10 | 3.67E-09 | 1.91E-08 | 200.81 |
| N439K + E484K (AV.1) | 3.57E-11 | 4.00E-10 | 3.92 | 1.22E-10 | 1.98E-09 | 15.58 | NC | NC | >2417.79[b] | 4.23E-10 | 2.99E-09 | 60.04 |
| N440K + E484K (B.1.619, B.1.619.1, B.1.625) | 3.25E-11 | 4.37E-10 | 3.57 | 2.03E-10 | 2.41E-09 | 25.89 | 1.85E-09 | 1.07E-07 | 223.53 | 2.76E-10 | 1.60E-09 | 39.20 |
| C.1.2 | 3.75E-11 | 2.03E-10 | 2.79 | 1.76E-10 | 1.22E-09 | 10.69 | 8.62E-12 | 8.51E-11 | 0.46 | 1.57E-11 | 8.03E-11 | 1.53 |
| All Single-Mutation Variants | | | | | | | | | | | | |
| Y145H | 1.88E-11 | 1.03E-10 | 1.40 | 1.61E-11 | 7.83E-11 | 0.98 | 2.13E-11 | 1.51E-10 | 1.15 | 1.46E-11 | 4.36E-11 | 1.43 |
| W152C | 1.24E-11 | 1.60E-10 | 0.34 | 4.99E-12 | 1.37E-10 | 0.34 | 9.60E-12 | 1.05E-10 | 0.69 | 8.86E-12 | 1.01E-10 | 0.65 |
| V308L | 2.86E-11 | 2.58E-10 | 0.79 | 1.39E-11 | 1.46E-10 | 0.95 | 1.62E-11 | 1.60E-10 | 1.17 | 1.23E-11 | 1.05E-10 | 0.90 |
| G339D | 5.47E-11 | 2.42E-10 | 1.46 | 2.54E-11 | 2.26E-10 | 0.94 | 2.52E-11 | 1.98E-10 | 1.00 | 2.22E-11 | 9.66E-11 | 1.43 |
| E340A | 2.16E-11 | 2.02E-10 | 0.74 | 2.36E-11 | 1.10E-10 | 0.78 | 2.13E-11 | 2.26E-10 | 0.59 | 1.48E-11 | 1.02E-10 | 1.22 |
| E340K | 2.54E-11 | 1.81E-10 | 0.86 | 1.98E-11 | 1.95E-10 | 0.65 | 1.63E-11 | 4.20E-10 | 0.45 | 1.13E-11 | 1.36E-10 | 0.93 |
| R346K | 3.95E-11 | 2.56E-10 | 2.99 | 2.45E-11 | 1.48E-10 | 1.44 | 2.90E-11 | 1.85E-10 | 2.51 | 2.10E-11 | 8.42E-11 | 2.39 |
| R346S | 3.21E-11 | 1.65E-10 | 1.36 | 2.31E-11 | 1.34E-10 | 1.54 | 2.76E-11 | 2.28E-10 | 1.53 | 1.90E-11 | 8.63E-11 | 1.39 |
| S371L | 2.62E-10 | 1.01E-09 | 7.00 | 1.37E-10 | 3.99E-10 | 5.07 | 1.78E-10 | 6.48E-10 | 7.07 | 9.21E-11 | 2.52E-10 | 5.96 |
| A372T | 3.00E-12 | 1.57E-10 | 0.16 | 2.01E-13 | 7.46E-12 | 0.05 | 4.09E-12 | 8.55E-11 | 0.35 | 3.46E-12 | 4.35E-11 | 0.35 |
| S373P | 3.58E-11 | 1.66E-10 | 0.96 | 1.90E-11 | 1.07E-10 | 0.71 | 1.88E-11 | 1.16E-10 | 0.74 | 1.26E-11 | 7.11E-11 | 0.82 |

TABLE 18-continued

IC$_{50}$ and IC$_{90}$ Values for mAb15160-Mediated Neutralization of Entry of pVSV-Luc-SARS-CoV-2-S Pseudotyped with S Protein Variants into Vero Cells

| | mAb15160 | | | mAb10933 (Casirivimab) | | | mAb10987 (Imdevimab) | | | Casirivimab + Imdevimab | | |
|---|---|---|---|---|---|---|---|---|---|---|---|---|
| SARS-CoV-2 S Protein Variant | IC$_{50}$ [M] | IC$_{90}$ [M] | Fold Change in IC$_{50}$ over Ref Virus | IC$_{50}$ [M] | IC$_{90}$ [M] | Fold Change in IC$_{50}$ over Ref Virus | IC$_{50}$ [M] | IC$_{90}$ [M] | Fold Change in IC$_{50}$ over Ref Virus | IC$_{50}$ [M] | IC$_{90}$ [M] | Fold Change in IC$_{50}$ over Ref Virus |
| S375F | 1.72E-11 | 7.65E-11 | 0.46 | 8.68E-12 | 1.13E-10 | 0.32 | 7.45E-12 | 2.75E-11 | 0.30 | 5.17E-12 | 4.04E-11 | 0.33 |
| D389Y | 6.90E-12 | 6.82E-11 | 0.17 | 2.24E-12 | 3.73E-11 | 0.12 | 5.74E-12 | 8.36E-11 | 0.41 | 4.69E-12 | 3.96E-11 | 0.24 |
| D405N | 3.26E-11 | 2.10E-10 | 1.38 | 3.06E-11 | 2.69E-10 | 2.04 | 1.29E-11 | 1.78E-10 | 0.71 | 1.73E-11 | 7.98E-11 | 1.27 |
| E406D | 1.91E-11 | 2.51E-10 | 1.91 | 5.69E-10 | 5.05E-09 | 110.30 | 2.08E-11 | 4.32E-10 | 2.31 | 3.67E-11 | 4.50E-10 | 4.60 |
| E406Q | 2.05E-11 | 1.72E-10 | 2.07 | 1.07E-09 | 6.74E-09 | 255.89 | 1.12E-11 | 1.63E-10 | 2.32 | 2.10E-11 | 2.99E-10 | 11.37 |
| K417N | 2.47E-11 | 2.29E-10 | 1.27 | 8.96E-11 | 1.15E-09 | 8.74 | 6.22E-12 | 7.65E-11 | 1.35 | 1.35E-11 | 5.16E-11 | 1.54 |
| K417R[c] | 5.04E-12 | 1.96E-11 | 2.37 | 4.10E-09 | 2.96E-08 | 61.23 | 2.92E-11 | 2.92E-10 | 1.70 | 1.24E-10 | 6.59E-10 | 2.45 |
| N439K | 2.13E-11 | 1.06E-10 | 0.57 | 4.47E-11 | 4.31E-10 | 0.60 | 1.77E-08 | 1.12E-07 | 231.51 | 7.25E-11 | 2.50E-10 | 1.69 |
| N440D | 5.41E-11 | 3.94E-10 | 2.28 | 1.69E-11 | 2.09E-10 | 1.04 | 1.92E-09 | 1.42E-08 | 119.13 | 6.71E-11 | 4.36E-10 | 4.90 |
| N440K | 2.44E-11 | 2.06E-10 | 1.26 | 1.02E-11 | 1.22E-10 | 0.99 | 1.34E-09 | 1.57E-08 | 291.40 | 1.88E-11 | 3.28E-10 | 2.15 |
| V445T | 2.23E-11 | 1.85E-10 | 0.94 | 2.27E-11 | 1.82E-10 | 1.52 | 7.25E-09 | 6.HEOS | 401.72 | 4.86E-11 | 4.00E-10 | 3.55 |
| G446D | 1.58E-11 | 2.80E-10 | 0.44 | 1.75E-11 | 1.79E-10 | 1.19 | 7.66E-09 | 3.38E-08 | 553.07 | 3.52E-11 | 2.71E-10 | 2.58 |
| G446R | 2.59E-11 | 1.72E-10 | 1.09 | 1.09E-11 | 1.05E-10 | 0.68 | 4.41E-09 | 4.26E-08 | 273.91 | 4.36E-11 | 2.74E-10 | 3.18 |
| G446S | 1.13E-11 | 1.74E-10 | 0.58 | 8.70E-12 | 7.95E-11 | 0.85 | 4.24E-09 | 1.61E-08 | 920.25 | 1.95E-11 | 2.24E-10 | 2.23 |
| Y449F | 2.03E-11 | 2.25E-10 | 0.64 | 8.48E-12 | 6.34E-11 | 0.59 | 1.07E-11 | 9.56E-11 | 0.96 | 6.23E-12 | 4.90E-11 | 0.82 |
| Y449H | 3.68E-11 | 2.12E-10 | 1.26 | 2.74E-11 | 1.56E-10 | 0.91 | 3.11E-12 | 6.68E-11 | 0.09 | 1.42E-11 | 1.43E-10 | 1.17 |
| Y449N | 2.68E-11 | 2.64E-10 | 1.13 | 1.23E-11 | 1.16E-10 | 0.82 | 5.14E-12 | 3.84E-11 | 0.28 | 7.83E-12 | 3.38E-11 | 0.57 |
| N450K | 4.75E-11 | 2.88E-10 | 0.83 | 4.40E-11 | 1.97E-10 | 0.91 | 2.95E-11 | 1.60E-10 | 0.84 | 3.18E-11 | 1.07E-10 | 0.91 |
| L452R | 5.83E-11 | 2.24E-10 | 1.55 | 5.60E-11 | 3.17E-10 | 0.76 | 7.83E-11 | 7.26E-10 | 1.03 | 4.96E-11 | 1.64E-10 | 1.15 |
| L455F | 3.15E-11 | 3.00E-10 | 0.78 | 7.69E-09 | 9.21E-08 | 426.00 | 1.93E-11 | 1.05E-10 | 1.39 | 2.73E-11 | 2.94E-10 | 1.39 |
| K458N | 4.50E-11 | 2.76E-10 | 1.86 | 1.76E-11 | 1.89E-10 | 1.14 | 1.92E-11 | 1.38E-10 | 1.60 | 1.39E-11 | 7.82E-11 | 2.58 |
| K458R | 2.20E-11 | 1.94E-10 | 2.77 | 7.59E-12 | 1.09E-10 | 1.36 | 7.71E-12 | 1.57E-10 | 0.96 | 6.58E-12 | 9.08E-11 | 1.28 |
| A475V | 1.47E-11 | 1.09E-10 | 0.61 | 1.48E-11 | 1.49E-10 | 0.96 | 1.05E-11 | 8.96E-11 | 0.88 | 8.43E-12 | 5.26E-11 | 1.56 |
| S477N | 3.78E-11 | 1.47E-10 | 1.01 | 9.78E-11 | 4.22E-10 | 1.32 | 6.54E-11 | 4.44E-10 | 0.86 | 4.15E-11 | 1.68E-10 | 0.97 |
| S477R | 3.87E-11 | 2.16E-10 | 1.60 | 1.29E-11 | 1.14E-10 | 0.84 | 3.19E-11 | 1.70E-10 | 2.67 | 1.19E-11 | 6.78E-11 | 2.19 |
| T478I | 4.19E-11 | 2.76E-10 | 1.73 | 2.44E-11 | 1.84E-10 | 1.58 | 2.42E-11 | 1.73E-10 | 2.02 | 1.58E-11 | 9.96E-11 | 2.93 |
| T478K | 2.45E-11 | 1.87E-10 | 1.26 | 7.11E-12 | 9.04E-11 | 0.69 | 1.23E-11 | 2.96E-10 | 2.66 | 6.28E-12 | 6.43E-11 | 0.72 |
| P479S | 2.63E-11 | 1.88E-10 | 1.09 | 2.31E-11 | 1.76E-10 | 1.50 | 2.12E-11 | 1.56E-10 | 1.77 | 1.03E-11 | 6.23E-11 | 1.90 |
| E484A | 5.09E-11 | 2.73E-10 | 1.36 | 1.03E-10 | 7.12E-10 | 3.83 | 1.10E-11 | 1.04E-10 | 0.43 | 1.87E-11 | 1.04E-10 | 1.21 |
| E484K | 5.97E-11 | 4.83E-10 | 2.84 | 2.49E-10 | 3.53E-09 | 5.55 | 2.62E-11 | 4.30E-10 | 1.01 | 3.20E-11 | 1.60E-10 | 3.67 |
| G485S | 2.30E-11 | 1.31E-10 | 0.97 | 4.24E-11 | 3.46E-10 | 2.83 | 1.23E-11 | 1.10E-10 | 0.68 | 1.93E-11 | 6.01E-11 | 1.41 |
| F486V | NC | NC | >531.21[b] | NC | NC | >269.61[b] | 5.75E-11 | 2.40E-10 | 0.75 | 9.85E-11 | 3.68E-10 | 2.29 |
| Y489H | 2.53E-09 | 6.61E-09 | 121.48 | NC | NC | >2311.60[b] | 3.55E-12 | 7.16E-11 | 0.35 | 2.15E-11 | 2.42E-10 | 2.57 |
| F490L | 5.68E-11 | 2.08E-10 | 1.94 | 2.96E-11 | 1.69E-10 | 0.98 | 2.37E-11 | 1.51E-10 | 0.65 | 1.43E-11 | 1.53E-10 | 1.18 |

TABLE 18-continued $IC_{50}$ and $IC_{90}$ Values for mAb15160-Mediated Neutralization of Entry of pVSV-Luc-SARS-CoV-2-S Pseudotyped with S Protein Variants into Vero Cells

| SARS-CoV-2 S Protein Variant | mAb15160 | | | mAb10933 (Casirivimab) | | | mAb10987 (Imdevimab) | | | Casirivimab + Imdevimab | | |
|---|---|---|---|---|---|---|---|---|---|---|---|---|
| | $IC_{50}$ [M] | $IC_{90}$ [M] | Fold Change in $IC_{50}$ over Ref Virus | $IC_{50}$ [M] | $IC_{90}$ [M] | Fold Change in $IC_{50}$ over Ref Virus | $IC_{50}$ [M] | $IC_{90}$ [M] | Fold Change in $IC_{50}$ over Ref Virus | $IC_{50}$ [M] | $IC_{90}$ [M] | Fold Change in $IC_{50}$ over Ref Virus |
| F490S | 1.76E-11 | 2.69E-10 | 0.60 | 2.53E-11 | 1.45E-10 | 0.84 | 7.24E-12 | 4.51E-10 | 0.20 | 1.65E-11 | 1.81E-10 | 1.36 |
| F490Y | 1.86E-11 | 1.67E-10 | 0.79 | 9.70E-12 | 1.47E-10 | 0.65 | 1.33E-11 | 1.51E-10 | 0.74 | 1.62E-11 | 7.39E-11 | 1.18 |
| Q493E | 8.85E-12 | 6.10E-11 | 1.11 | NC | NC | >3588.73[b] | 1.34E-11 | 8.69E-11 | 1.67 | 3.05E-11 | 2.69E-10 | 5.95 |
| Q493K | 4.57E-11 | 6.68E-10 | 3.40 | 6.25E-09 | 1.31E-07 | 378.67 | 1.77E-11 | 1.53E-10 | 0.95 | 4.22E-11 | 3.40E-10 | 4.11 |
| Q493R | 9.47E-11 | 5.79E-10 | 4.88 | 8.68E-10 | 8.94E-09 | 84.71 | 1.76E-11 | 1.12E-10 | 3.82 | 2.79E-11 | 2.56E-10 | 3.18 |
| G496S | 4.53E-11 | 1.72E-10 | 1.21 | 2.25E-11 | 1.07E-10 | 0.83 | 1.28E-10 | 9.49E-10 | 5.08 | 2.66E-11 | 9.64E-11 | 1.72 |
| Q498R | 4.72E-11 | 2.55E-10 | 1.26 | 1.89E-11 | 2.02E-10 | 0.70 | 1.93E-11 | 2.00E-10 | 0.77 | 1.53E-11 | 7.85E-11 | 0.99 |
| T500A | 1.18E-12 | 6.09E-10 | 0.12 | 3.74E-12 | 3.45E-10 | 0.90 | 4.91E-11 | 4.77E-10 | 10.21 | 9.85E-12 | 1.05E-10 | 5.32 |
| T500F | 8.35E-12 | 1.97E-10 | 0.84 | 2.76E-12 | 8.39E-11 | 0.66 | 1.70E-12 | 2.56E-11 | 0.35 | 2.54E-12 | 1.90E-11 | 1.37 |
| N501Y | 5.40E-11 | 2.79E-10 | 2.78 | 2.13E-11 | 2.08E-10 | 2.08 | 6.85E-12 | 8.63E-11 | 1.49 | 1.03E-11 | 5.18E-11 | 1.17 |
| Y505F | 4.34E-11 | 3.08E-10 | 1.07 | 2.06E-11 | 2.27E-10 | 1.14 | 1.84E-11 | 1.50E-10 | 1.32 | 1.62E-11 | 1.10E-10 | 0.82 |
| Y505H | 2.84E-11 | 1.64E-10 | 0.76 | 1.40E-11 | 8.52E-11 | 0.52 | 9.54E-12 | 5.75E-11 | 0.38 | 1.40E-11 | 5.52E-11 | 0.91 |

[a]Full sequences and/or key residues of the S protein from variants under surveillance; full S protein sequences: B.1.1.7 (H69del, V70del, Y145del, N501Y, A570D, D614G, P681H, T716I, S982A, D1118H), B.1.351 (D80Y, D215G, L241del, L242del, A243del, K417N, E484K, N501Y, D614G, A701V), P.1 (L18F, T20N, P26S, D138Y, R190S, K417T, E484K, N501Y, D614G, H655Y, T1027I, V1176F), B.1.617.2 (T19R, G142D, E156G, F157del, R158del, L452R, T478K, D614G, P681R, D950N), B.1.617.1 (T95I, G142D, E154K, L452R, E484Q, D614G, P681R, Q1071H), BA.1 (A67V, del69-70, T95I, G142D/del143-145, del211/L212I, ins214EPE, G339D, S371L, S373P, S375F, K417N, N440K, G446S, S477N, T478K, E484A, Q493R, G496S, Q498R, N501Y, Y505H, T547K, D614G, H655Y, N679K, P681H, N764K, D796Y, N856K, Q954H, N969K, L981F), BA.1.1 (BA.1 + R346K), BA.2 (T19I, del24-26, A27S, G142D, V213G, G339D, S371F, S373P, S375F, T376A, D405N, R408S, K417N, N440K, S477N, T478K, E484A, Q493R, Q498R, N501Y, Y505H, D614G, H655Y, N679K, P681H, N764K, D796Y, Q954H, N969K); key S protein residues: AY.1 (K417N + L452R + T478K), AY4.2 (Y145H + A222V + L452R + T478K), B.1.427/B.1.429 (L452R), B.1.526 (E484K), B.1.621 (R346K + E484K + N501Y), AV.1 (N439K + E484K), B.1.619/B.1.619.1/B.1.625 (N440K + E484K), C.1.2 (Y449H + E484K + N501Y).
[b]Where an $IC_{50}$ value could not be accurately calculated, the change in mAb potency in the presence of each mutant was calculated by dividing the maximum antibody concentration tested (20 nM) by the $IC_{50}$ value calculated for casirivimab, imdevimab, or casirivimab + imdevimab in the presence of reference pVSV-SARS-CoV-2-S pseudoparticles.
[c]The $IC_{50}$ and $IC_{90}$ values for neutralization of this variant by mAb15160 and imdevimab were compared to different reference virus datasets than casirivimab and casirivimab + imdevimab.
del, deletion; ins, insertion; NA, not applicable; NC, not calculated due to poor or lack of neutralization; NT, not tested
Fold change calculated relative to D614G control

TABLE 19

Summary of $IC_{50}$ and $IC_{90}$ Values for REGN14284-Mediated Neutralization of Entry of pVSV-Luc-SARS-CoV-2-S Pseudotyped with S Protein Variants into Vero Cells

| | SARS-CoV-2 S Protein Variant | $IC_{50}$ [M] | $IC_{90}$ [M] | Fold Change in $IC_{50}$ over Ref Virus |
|---|---|---|---|---|
| Full Sequences or Key Residues of Variants under Surveillance[a] and Other Multi-Variant Lineages | | | | |
| Alpha | B.1.1.7[a] | 1.14E-11 | 7.58E-11 | 1.14 |
| Beta | B.1.351[a] | 9.73E-12 | 6.15E-11 | 0.98 |
| Gamma | P.1[a] | 8.34E-12 | 7.52E-11 | 0.84 |
| Delta | B.1.617.2[a] | 6.09E-12 | 6.07E-11 | 0.69 |
| | K417N + L452R + T478K (AY.1) * | 3.42E-12 | 3.53E-11 | 0.50 |
| | Y145H + A222V + L452R + T478K (AY4.2) | 2.53E-11 | 2.34E-10 | 0.75 |
| Epsilon | W152C + L452R (B.1.427/B.1.429) | 1.28E-11 | 9.23E-11 | 1.18 |
| Iota | E484K[(B.1.526)] | 5.40E-11 | 5.30E-10 | 1.61 |
| Kappa | B.1.617.1[a] | 4.24E-11 | 3.84E-10 | 1.26 |
| Lambda | F490S + L452Q (C.37) * | 1.20E-11 | 1.58E-10 | 1.17 |
| Mu | R346K + E484K + N501Y (B.1.621) | 9.89E-12 | 8.66E-11 | 0.99 |
| Omicron | BA.1[a] * | 8.86E-12 | 1.09E-10 | 1.63 |
| | BA.1.1[a] | 1.00E-11 | 1.03E-10 | 0.58 |
| | BA.2[a] * | 1.13E-11 | 1.54E-10 | 0.98 |

TABLE 19-continued

Summary of IC$_{50}$ and IC$_{90}$ Values for REGN14284-Mediated Neutralization of Entry
of pVSV-Luc-SARS-CoV-2-S Pseudotyped with S Protein Variants into Vero Cells

| | SARS-CoV-2 S Protein Variant | IC$_{50}$ [M] | IC$_{90}$ [M] | Fold Change in IC$_{50}$ over Ref Virus |
|---|---|---|---|---|
| | BA.2.12.1[a] * | 2.55E−11 | 2.12E−10 | 1.40 |
| | BA.3[a] | 2.22E−11 | 4.41E−10 | 2.52 |
| | BA.4/BA.5[a] * | 1.85E−11 | 1.89E−10 | 0.79 |
| NA | C.1.2 | 3.16E−11 | 3.20E−10 | 0.94 |
| | All Single-Mutation Variants | | | |
| W152C | | 9.40E−12 | 6.46E−11 | 0.81 |
| S247R | | 3.70E−11 | 3.53E−11 | 0.90 |
| V308L | | 1.38E−11 | 1.30E−10 | 1.19 |
| N334D | | 6.69E−12 | 1.75E−10 | 1.01 |
| G339D | | 4.01E−11 | 2.86E−10 | 1.68 |
| E340A | | 1.43E−11 | 1.28E−10 | 1.86 |
| E340K | | 1.16E−11 | 8.07E−11 | 1.51 |
| R346K | | 1.04E−11 | 9.43E−11 | 1.41 |
| R346S | | 2.73E−11 | 1.05E−10 | 1.59 |
| S371F | | 4.66E−11 | 2.80E−10 | 12.75 |
| S371Y | | 4.00E−11 | 3.21E−10 | 7.78 |
| A372T | | 1.16E−11 | 1.14E−10 | 1.56 |
| T376A | | 2.64E−12 | 4.44E−11 | 0.72 |
| T376S | | 1.54E−11 | 1.59E−10 | 0.65 |
| D405N | | 8.15E−12 | 7.93E−11 | 0.47 |
| E406W | | 1.67E−11 | 4.82E−10 | 1.91 |
| R408S | | 9.12E−12 | 6.38E−11 | 2.49 |
| K417T | | 6.45E−12 | 7.44E−11 | 1.76 |
| Y421F | | 4.47E−12 | 8.04E−11 | 0.51 |
| N439K | | 4.13E−11 | 8.23E−10 | 1.98 |
| N439V | | 1.59E−11 | 1.97E−10 | 0.76 |
| N440D | | 5.16E−11 | 5.34E−10 | 2.47 |
| N440K | | 3.09E−11 | 7.31E−10 | 1.48 |
| L441F | | 1.80E−11 | 1.36E−10 | 0.86 |
| L441Q | | 2.78E−11 | 2.69E−10 | 1.33 |
| K444L | | NC | NC | >957.40[b] |
| K444M | | 5.23E−10 | 5.92E−09 | 25.03 |
| K444N | | NC | NC | >957.40[b] |
| K444Q | | 4.93E−09 | 5.90E−08 | 236.00 |
| K444R | | 4.33E−12 | 4.92E−11 | 1.54 |
| K444T | | NC | NC | >5599.10[b] |
| V445A | | 1.88E−10 | 2.81E−09 | 57.18 |
| V445T | | 9.18E−10 | 8.56E−09 | 53.44 |
| G446D | | 2.34E−10 | 1.94E−09 | 20.28 |
| G446R | | 3.37E−11 | 2.51E−10 | 10.23 |
| G446S | | 8.96E−12 | 6.40E−11 | 2.72 |
| G446V | | 3.38E−11 | 7.30E−10 | 9.46 |
| G447V | | 2.35E−11 | 3.12E−10 | 8.34 |
| N448S | | 2.62E−12 | 4.64E−11 | 0.30 |
| Y449D | | 8.48E−12 | 1.01E−10 | 2.57 |
| Y449F | | 7.32E−12 | 4.74E−11 | 0.85 |
| Y449H | | 1.04E−11 | 8.45E−11 | 1.36 |
| Y449N | | 7.92E−12 | 9.05E−11 | 0.46 |
| Y449S | | 8.70E−12 | 8.60E−11 | 2.64 |
| N450K | | 8.36E−12 | 1.19E−10 | 0.72 |
| L452M | | 8.87E−12 | 6.13E−11 | 2.16 |
| L452Q | | 2.61E−11 | 1.79E−10 | 1.10 |
| L452R | | 5.49E−11 | 7.32E−10 | 1.63 |
| F456L | | 5.87E−12 | 1.05E−10 | 0.67 |
| Y473F | | 6.01E−12 | 8.57E−11 | 0.68 |
| A475V | | 7.47E−12 | 8.37E−11 | 0.65 |
| S477N | | 1.37E−11 | 2.02E−10 | 1.70 |
| T478K | | 1.34E−11 | 1.69E−10 | 1.66 |
| E484A | | 1.38E−11 | 1.74E−10 | 0.58 |
| E484K | | 5.40E−11 | 5.30E−10 | 1.61 |
| E484Q | | 3.04E−12 | 4.51E−11 | 0.35 |
| G485S | | 8.52E−12 | 9.47E−11 | 0.50 |
| G485V | | 9.62E−12 | 9.33E−11 | 1.10 |
| F486S | | 1.79E−11 | 5.36E−10 | 2.03 |
| F486V | | 6.23E−11 | 3.18E−10 | 7.72 |
| Y489H | | 8.93E−13 | 4.43E−11 | 0.15 |
| F490L | | 2.12E−11 | 1.41E−10 | 2.76 |
| F490S | | 2.04E−11 | 1.19E−10 | 2.65 |
| F490Y | | 1.20E−11 | 7.26E−11 | 0.70 |
| Q498H | | 1.10E−11 | 1.41E−10 | 3.09 |
| Q498R | | 2.24E−11 | 1.35E−10 | 0.94 |

TABLE 19-continued

Summary of $IC_{50}$ and $IC_{90}$ Values for REGN14284-Mediated Neutralization of Entry of pVSV-Luc-SARS-CoV-2-S Pseudotyped with S Protein Variants into Vero Cells

| SARS-CoV-2 S Protein Variant | $IC_{50}$ [M] | $IC_{90}$ [M] | Fold Change in $IC_{50}$ over Ref Virus |
| --- | --- | --- | --- |
| T500A | 1.46E−11 | 1.02E−10 | 4.07 |
| T500F | 8.56E−12 | 3.85E−11 | 2.40 |
| T500N | 2.28E−11 | 1.52E−10 | 3.45 |
| N501T | 5.57E−12 | 3.47E−11 | 1.69 |
| N501Y | 1.22E−11 | 1.42E−10 | 1.51 |
| Y505H | 2.46E−11 | 2.00E−10 | 1.03 |

*The values shown for the indicated variant/reference virus represent the geometric mean from at least 3 replicate assays.
<sup>a</sup>Full S protein sequences and/or key residues of variants under surveillance were assessed. Key residues assessed and the lineages they represent are shown in the table. Full sequences are indicated by footnote 'a' within the table and contain the following substitutions in the Wuhan-Hu-1 S protein reference sequence: B.1.1.7 (H69del, V70del, Y145del, N501Y, A570D, D614G, P681H, T716I, S982A, D1118H), B.1.351 (D80Y, D215G, L241del, L242del, A243del, K417N, E484K, N501Y, D614G, A701V), P.1 (L18F, T20N, P26S, D138Y, R190S, K417T, E484K, N501Y, D614G, H655Y, T1027I, V1176F), B.1.617.2 (T19R, G142D, E156G, F157del, R158del, L452R, T478K, D614G, P681R, D950N), B.1.617.1 (T95I, G142D, E154K, L452R, E484Q, D614G, P681R, Q1071H), BA.1 (A67V, del69-70, T95I, G142D/del143-145, del211/L212I, ins214EPE, G339D, S371L, S373P, S375F, K417N, N440K, G446S, S477N, T478K, E484A, Q493R, Q496S, Q498R, N501Y, Y505H, T547K, D614G, H655Y, N679K, P681H, N764K, D796Y, N856K, Q954H, N969K, L981F). BA.1.1 (BA.1 + R346K), BA.2 (T19I, del24-26, A27S, G142D, V213G, G339D, S371F, S373P, S375F, T376A, D405N, R408S, K417N, N440K, S477N, T478K, E484A, Q493R, Q498R, N501Y, Y505H, D614G, H655Y, N679K, P681H, N764K, D796Y, Q954H, N969K), BA.2.12.1 (BA.2 + L452Q), BA.3 (G142D, G339D, S371F, S373P, S375F, D405N, K417N D614G, H655Y, N679K, P681H, D796Y, Q954H, N969K), BA.4/BA.5 (both lineages have an identical S protein sequence [T19I, L24del, P25del, P26del, A27S, H69del, V70del, G142D, V213G, G339D, S371F, S373P, S375F, T376A, D405N, R408S, K417N, N440K, L452R, S477N, T478K, E484A, F486V, Q498R, N501Y, Y505H, D614G, H655Y, N679K, P681H, N764K, D796Y, Q954H, N969K])
<sup>b</sup>Where an $IC_{50}$ value could not be accurately calculated, the change in mAb potency in the presence of each mutant was calculated by dividing the maximum antibody concentration tested (20 nM) by the $IC_{50}$ value calculated for the antibody in the presence of reference pVSV-SARS-CoV-2-S pseudoparticles.
del, deletion; ins, insertion; NC, not calculated due to poor or lack of neutralization
mAb14284 was tested at concentrations ranging from approximately 300 fM to 20 nM. Fold change over reference (ref) virus was calculated by dividing the $IC_{50}$ value determined for the antibody in the presence of a particular variant by the $IC_{50}$ value determined for the antibody in the presence of reference pseudoparticles (pVSV-SARS-CoV-2 pseudotyped with the D614G mutation) from the same assay.

Example 5: Anti-SARS-CoV-2 Antibodies Block RBD Binding to hACE2 as Determined by ELISA An ELISA-based blocking assay was used to determine the ability of anti-SARS-CoV-2 antibodies to block the binding of the SARS-COV-2 Spike protein receptor binding domain (RBD) to its receptor, human angiotensin converting enzyme 2 (hACE2).

The SARS-CoV-2 protein used in this assay was comprised of the receptor binding domain (RBD) portion of the SARS-CoV-2 Spike protein (amino acids Arg319-Phe541) expressed with a C-terminal myc-myc-6-Histidine tag (SARS-CoV-2 RBD.mmh). The human ACE-2 protein used in the experiments was purchased from R&D Systems, comprising a portion of the human ACE-2 extracellular domain (amino acids Leu18-Ser740) and a C-terminal 10-Histidine tag (hACE-2-10His; ACE2 NCBI Accession No. Q9BYF1).

Experiments were carried out using the following procedure. The hACE-2-10His receptor was coated at 2 µg/ml in PBS on a 96-well microtiter plate overnight at 4° C. Nonspecific binding sites were subsequently blocked using a 0.5% (w/v) solution of BSA in PBS. In other microtiter plates, a constant amount of 300 pM of SARS-CoV-2 RBD.mmh protein was bound for one hour with anti-SARS-COV-2-S antibodies or an irrelevant human IgG1 antibody control at dilutions from 1.7 pM to 100 nM in PBS+0.5% BSA. The fixed concentration of SARS-CoV-2 RBD was selected to be near the concentration which generated 50% of the maximal binding (EC50 value) to the plate-adhered hACE-2. The antibody-protein complexes were transferred to the microtiter plate coated hACE-2-10His. After 1 hour of incubation at room temperature, the wells were washed, and plate-bound SARS-COV-2 RBD.mmh was detected with a polyclonal goat anti-myc antibody conjugated with horseradish peroxidase (HRP) (NovusBio). The plates were then developed using TMB substrate solution (BD Biosciences, #51-2606KC and #51-2607KC) according to the manufacturer's recommended procedure and absorbance at 450 nm was measured on a Victor X5 plate reader (PerkinElmer, Shelton CT).

Binding data were analyzed using a sigmoidal dose-response model within Prism™ software (GraphPad). The calculated IC50 value, defined as the concentration of antibody required to block 50% of SARS-CoV-2 RBD binding to plate-coated hACE2, was used as an indicator of blocking potency. Percent blocking of anti-SARS-CoV-2-S antibody at a given concentration was calculated based on the following formula:

$$\% \text{ Blocking} = 100 - \left( \frac{[\text{Experimental Signal}_{(highest\ Ab\ conc)} - \text{Background Signal}_{(buffer)}]}{[\text{Maximum Signal}_{(hEGF.\ mFc\ alone)} - \text{Background Signal}_{(buffer)}]} \times 100 \right)$$

Antibodies that blocked binding less than or equal to 50% at the highest concentration tested were classified as non-blockers and IC50 values were not reported for those antibodies.

The ability of anti-SARS-CoV-2 antibodies to block SARS-CoV-2 RBD binding to human ACE2 was assessed using a blocking ELISA. In this assay 300 pM SARS-COV-2 RBD.mmh was titrated with a wide concentration range of the anti-SARS-COV-2-S antibody. The inhibition of the binding of the SARS-COV-2 RBD to hACE-2 in the presence of the SARS-COV-2 antibody was evaluated. The plate-bound SARS-COV-2 RBD.mmh was detected with a HRP-conjugated goat anti-myc antibody. The IC50 values and maximum blocking at the highest tested concentrations of the SARS-COV-2 antibodies are summarized in Table 20.

Of the fifty-six antibodies tested, forty-two displayed antibody concentration-dependent blocking of SARS-COV-2 RBD binding to hACE-2 with maximum blocking ranging from 61% to about 100% at the highest antibody concentration tested (100 nM). The IC50 values for the identified blocking antibodies ranged from 102 pM to 19.7 nM. The remaining fourteen antibodies displayed less than 50% blocking activity at the highest concentration tested and were classified as non-blockers. An isotype control, mAb193281, was also used as a control.

TABLE 20

Blocking potency of Anti-SAR-COV-2-S Antibodies on Spike RBD-hFc Binding to Immobilized Human ACE-2

| mAb# | $IC_{50}$, M | Antibody blocking 300 pM SARS-COV-2.mmh binding to hACE-2 % Blocking at 100 nM mAb concentration |
|---|---|---|
| mAb13457 | 1.97E−08 | 75 |
| mAb13458 | 8.73E−10 | 81 |
| mAb13459 | 4.43E−09 | 78 |
| mAb14230 | 9.97E−09 | 85 |
| mAb14231 | Nbl | 2 |
| mAb14232 | 1.80E−08 | 87 |
| mAb14233 | Nbl | −7 |
| mAb14234 | 4.62E−09 | 92 |
| mAb14235 | 2.34E−10 | 96 |
| mAb14247 | 4.46E−10 | 95 |
| mAb14248 | Nbl | −12 |
| mAb14249 | Nbl | −12 |
| mAb14255 | 1.57E−10 | 92 |
| mAb14256 | 4.80E−10 | 95 |
| mAb14257 | 3.65E−10 | 95 |
| mAb14258 | 1.21E−10 | 93 |
| mAb14259 | 1.03E−08 | 89 |
| mAb14260 | 1.27E−10 | 96 |
| mAb14280 | 1.74E−09 | 98 |
| mAb14281 | 3.97E−10 | 100 |
| mAb14282 | 5.02E−10 | 96 |
| mAb14283 | 3.73E−10 | 97 |
| mAb14284 | 3.67E−10 | 98 |
| mAb14285 | 1.70E−09 | 96 |
| mAb14286 | 6.41E−10 | 94 |
| mAb14287 | Nbl | 2 |
| mAb14288 | Nbl | 5 |
| mAb14290 | Nbl | −1 |
| mAb14289 | 3.78E−10 | 98 |
| mAb14291 | Nbl | −8 |
| mAb14292 | 2.54E−10 | 95 |
| mAb14293 | Nbl | −1 |
| mAb14294 | 2.44E−10 | 94 |
| mAb14295 | Nbl | 5 |
| mAb14296 | Nbl | 20 |
| mAb14297 | Nbl | 16 |
| mAb14312 | 1.34E−10 | 98 |
| mAb14313 | 1.64E−08 | 63 |
| mAb14314 | Nbl | 21 |
| mAb14315 | 1.72E−08 | 61 |
| mAb14316 | Nbl | −9 |
| mAb15156 | 2.69E−10 | 103 |
| mAb15157 | 3.57E−10 | 103 |
| mAb15158 | 3.09E−10 | 103 |
| mAb15159 | 1.56E−10 | 102 |
| mAb15160 | 2.04E−10 | 96 |
| mAb15161 | 5.84E−10 | 94 |
| mAb15162 | 7.56E−10 | 95 |
| mAb15163 | 2.17E−10 | 95 |
| mAb15164 | 2.45E−10 | 99 |
| mAb15165 | 1.89E−10 | 99 |
| mAb15166 | 4.75E−10 | 98 |
| mAb15167 | 1.06E−09 | 96 |

TABLE 20-continued

Blocking potency of Anti-SAR-COV-2-S Antibodies on Spike RBD-hFc Binding to Immobilized Human ACE-2

| mAb# | $IC_{50}$, M | Antibody blocking 300 pM SARS-COV-2.mmh binding to hACE-2 % Blocking at 100 nM mAb concentration |
|---|---|---|
| mAb15170 | 1.02E−10 | 82 |
| mAb15150 | 2.54E−10 | 98 |
| mAb15151 | 6.41E−10 | 98 |
| mAb193281 | Nbl | 15 |
| mAb193281 | Nbl | 16 |

Nbl: Non-Blocking - % blocking is less than or equal to 50%.

Example 6: pH Sensitivity of Anti-SARS-CoV-2-S Monoclonal Antibodies Binding to Monomeric SARS-CoV-2-S RBD Reagents Measured at 37° C.

The dissociation rate constants ($k_d$) for 56 purified anti-SARS-CoV-2-S monoclonal antibodies at neutral and acidic pH conditions were determined using a real-time surface plasmon resonance (SPR)-based Biacore T200 or Biacore 4000 biosensor. All binding studies were performed at 37° C. using running buffers of 0.05% v/v Surfactant Tween-20-containing PBS at pH7.4, pH6.0, and pH5.0 (PBS-T-pH7.4, -pH6.0, and -pH5.0, respectively). The Biacore CM5 sensor chip surface was first derivatized by amine coupling with a mouse anti-human Fc specific mAb (Regeneron, mAb2567) to capture anti-SARS-CoV-2 monoclonal antibodies. The ligand examined for binding to anti-SARS-CoV-2 monoclonal antibodies was a recombinant protein comprising the SARS-COV-2 RBD extracellular domain expressed with a C-terminal tag of myc-myc-hexahistidine (SARS-COV-2 RBD-MMH; SEQ ID NO: 1069). Solutions of 90 nM SARS-COV-2 RBD-MMH were prepared in PBS-T-pH7.4 buffer and then injected over the antibody surfaces at a flow rate of 25 µL/min for 3 minutes followed by a dissociation phase of bound SARS-COV-2 RBD-MMH with the running buffers at pH7.4, pH6.0, or pH5.0 flowing over for 8 minutes. An isotype control, mAb1932, was also used as a control.

The dissociation rate constants ($k_d$) in three pH running buffers were determined by fitting the real-time binding sensorgrams to a 1:1 binding model using Scrubber 2.0c curve-fitting software. The dissociative half-life (t½) was calculated from the $k_d$ values as:

$$t^{1/2}(\min) = \frac{\ln(2)}{60 * kd}$$

The resultant $k_d$ and t½ values for binding of monomeric SARS-COV-2 RBD-MMH to 56 anti-SARS-CoV-2 monoclonal antibodies captured on anti-hFc surfaces at pH6.0 and pH5.0 at 37° C. are summarized in Table 21 and Table 22, respectively, and the results at pH7.4 are listed in both tables for comparison.

TABLE 21

Comparison of the Dissociation Rate Constant and Dissociative Half-life of the Interaction of Monomeric SARS-COV-2 RBD-MMH to Anti-SARS-CoV-2 Monoclonal Antibodies at pH 7.4 and pH 6.0 at 37° C.

| mAb Captured | mAb Capture Level (RU) | RBD.mmh Bound at pH 7.4 (RU) | kd at pH 7.4 (1/s) | t½ at pH 7.4 (min) | mAb Capture Level (RU) | RBD.mmh Bound at pH 7.4 (RU) | Kd at pH 6.0 (1/s) | t½ at pH 6.0 (min) | t½ Ratio of pH 7.4 to pH 6.0 |
|---|---|---|---|---|---|---|---|---|---|
| mAb14284 | 386.5 | 146.9 | 6.24E−04 | 18.5 | 369.4 | 144.5 | 5.74E−04 | 20.1 | 0.9 |
| mAb14312 | 276.1 | 95.2 | 8.59E−04 | 13.5 | 257.6 | 94.8 | 1.77E−03 | 6.5 | 2.1 |
| mAb14294 | 222.4 | 83.2 | 9.20E−04 | 12.6 | 207 | 91.1 | 5.65E−04 | 20.5 | 0.6 |
| mAb14315 | 238 | 83.3 | 9.80E−04 | 11.8 | 217.5 | 82.5 | 9.46E−04 | 12.2 | 1 |
| mAb14292 | 241.2 | 73.4 | 1.41E−03 | 8.2 | 218.6 | 74 | 1.78E−03 | 6.5 | 1.3 |
| mAb14235 | 202.9 | 71.2 | 1.48E−03 | 7.8 | 185.2 | 80.8 | 1.14E−03 | 10.1 | 0.8 |
| mAb14247 | 137.5 | 40.8 | 1.58E−03 | 7.3 | 107.4 | 43.8 | 1.67E−03 | 6.9 | 1.1 |
| mAb13458 | 290.7 | 96.5 | 1.61E−03 | 7.2 | 265.5 | 98.6 | 1.99E−03 | 5.8 | 1.2 |
| mAb14283 | 246.6 | 87.7 | 1.69E−03 | 6.9 | 224.5 | 86.3 | 2.00E−03 | 5.8 | 1.2 |
| mAb14289 | 246.7 | 86.1 | 1.85E−03 | 6.2 | 224 | 84 | 2.72E−03 | 4.2 | 1.5 |
| mAb14260 | 208 | 74.5 | 1.88E−03 | 6.2 | 192.7 | 83 | 1.66E−03 | 6.9 | 0.9 |
| mAb14258 | 245.1 | 85.9 | 2.13E−03 | 5.4 | 221.1 | 85 | 5.48E−04 | 21.1 | 0.3 |
| mAb13457 | 309 | 103.3 | 2.14E−03 | 5.4 | 279.3 | 100.8 | 3.09E−03 | 3.7 | 1.5 |
| mAb14234 | 133.8 | 37.9 | 2.21E−03 | 5.2 | 103 | 44.5 | 1.43E−03 | 8.1 | 0.6 |
| mAb13459 | 301.6 | 106.8 | 2.29E−03 | 5.1 | 290 | 114.8 | 2.39E−03 | 4.8 | 1.1 |
| mAb14313 | 275.7 | 94.2 | 2.51E−03 | 4.6 | 255 | 97.1 | 4.10E−03 | 2.8 | 1.6 |
| mAb14255 | 288.4 | 97.5 | 4.93E−03 | 2.3 | 262.3 | 96.4 | 5.13E−03 | 2.3 | 1 |
| mAb14281 | 256.9 | 83.5 | 6.59E−03 | 1.8 | 233.5 | 85.2 | 7.34E−03 | 1.6 | 1.1 |
| mAb14230 | 224.5 | 67.6 | 7.71E−03 | 1.5 | 193.5 | 70.7 | 7.97E−03 | 1.4 | 1.1 |
| mAb14257 | 234.8 | 82.3 | 7.78E−03 | 1.5 | 220.2 | 91.3 | 8.42E−03 | 1.4 | 1.1 |
| mAb14286 | 259 | 84.3 | 9.68E−03 | 1.2 | 234.5 | 87.2 | 9.99E−03 | 1.2 | 1 |
| mAb14256 | 258.4 | 80.2 | 1.11E−02 | 1 | 234.3 | 84.4 | 9.55E−03 | 1.2 | 0.8 |
| mAb14282 | 215.3 | 73.5 | 1.26E−02 | 0.9 | 199.9 | 83.5 | 9.85E−03 | 1.2 | 0.8 |
| mAb14280 | 255 | 72.4 | 2.40E−02 | 0.5 | 230.3 | 78.4 | 1.90E−02 | 0.6 | 0.8 |
| mAb14285 | 213 | 64.2 | 2.58E−02 | 0.4 | 200.2 | 77.1 | 1.44E−02 | 0.8 | 0.5 |
| mAb14232 | 58.1 | 8.2 | 3.11E−02 | 0.4 | 34.4 | 23 | 1.24E−02 | 0.9 | 0.4 |
| mAb14259 | 233.1 | 12 | IC | IC | 210.5 | 16.7 | IC | IC | IC |
| mAb14314 | 255.1 | 5.8 | IC | IC | 244.4 | 12.5 | IC | IC | IC |
| mAb14231 | 272 | 0.1 | NB | NB | 244.5 | 5 | NB | NB | NB |
| mAb14233 | 197 | 1.7 | NB | NB | 164.3 | 3.3 | NB | NB | NB |
| mAb14248 | 230.5 | 0.9 | NB | NB | 205.6 | 5.5 | NB | NB | NB |
| mAb14249 | 215.1 | 0.2 | NB | NB | 198.1 | 8.7 | NB | NB | NB |
| mAb14287 | 254.4 | 1.1 | NB | NB | 233 | 4.3 | NB | NB | NB |
| mAb14288 | 216.2 | 0.9 | NB | NB | 201.3 | 8.8 | NB | NB | NB |
| mAb14290 | 245 | 0.3 | NB | NB | 223.1 | 5.1 | NB | NB | NB |
| mAb14291 | 200.5 | 0.9 | NB | NB | 185 | 9.5 | NB | NB | NB |
| mAb14293 | 257.1 | 1.4 | NB | NB | 233.3 | 5.8 | NB | NB | NB |
| mAb14295 | 259.7 | 2.1 | NB | NB | 239.1 | 1.6 | NB | NB | NB |
| mAb14296 | 276.5 | 1.7 | NB | NB | 257.1 | 4.1 | NB | NB | NB |
| mAb14297 | 229 | 2.2 | NB | NB | 214.7 | 9.3 | NB | NB | NB |
| mAb14316 | 201.7 | 2.1 | NB | NB | 180.1 | 5.6 | NB | NB | NB |
| mAb15156 | 268.5 | 92.6 | 6.73E−03 | 1.7 | 258.3 | 96.4 | 9.70E−03 | 1.2 | 1.4 |
| mAb15157 | 311.9 | 106.3 | 4.05E−03 | 2.9 | 301.7 | 107.8 | 7.66E−03 | 1.5 | 1.9 |
| mAb15158 | 306.9 | 111.4 | 3.10E−04 | 37 | 294.7 | 118.1 | 2.90E−04 | 40.1 | 0.9 |
| mAb15159 | 92.9 | 31.9 | 2.31E−04 | 50 | 79.8 | 36.3 | 4.12E−04 | 28.1 | 1.8 |
| mAb15160 | 178.8 | 58.2 | 2.18E−03 | 5.3 | 164.8 | 59.9 | 2.83E−03 | 4.1 | 1.3 |
| mAb15161 | 121.5 | 39.8 | 1.13E−03 | 10.3 | 106.2 | 43.7 | 1.07E−03 | 10.8 | 0.9 |
| mAb15162 | 330.8 | 116.4 | 3.00E−03 | 3.9 | 321.2 | 120.1 | 3.54E−03 | 3.3 | 1.2 |
| mAb15163 | 230.9 | 81.9 | 4.94E−04 | 23.4 | 211.7 | 82.4 | 1.04E−03 | 11.1 | 2.1 |
| mAb15164 | 400.6 | 144.9 | 2.26E−03 | 5.1 | 398.3 | 154.4 | 2.10E−03 | 5.5 | 0.9 |
| mAb15165 | 290.4 | 110 | 1.64E−03 | 7.1 | 279.8 | 115 | 1.28E−03 | 9.1 | 0.8 |
| mAb15166 | 244.5 | 65.2 | 3.00E−02 | 0.4 | 234.8 | 66 | 3.01E−02 | 0.4 | 1 |
| mAb15167 | 419.3 | 117.5 | 2.08E−02 | 0.6 | 415.8 | 124.2 | 1.62E−02 | 0.7 | 0.8 |
| mAb15170 | 309.8 | 120.5 | 1.07E−04 | 108.4 | 304.6 | 128.6 | 8.00E−05 | 144.5 | 0.7 |
| mAb15150 | 246.1 | 87.8 | 1.12E−04 | 103.4 | 233.4 | 89.7 | 3.81E−05 | 303.5 | 0.3 |
| mAb15151 | 611.4 | 219.4 | 6.80E−03 | 1.7 | 612.7 | 227.1 | 4.54E−03 | 2.5 | 0.7 |
| mAb1932 | 314 | 0.6 | NB | NB | 294.3 | 7.7 | NB | NB | NB |

NB: No binding (NB) was observed under the current experimental conditions.

IC: Observed binding did not fit to the binding simulation model and no binding kinetic parameters were determined under the current experimental conditions.

TABLE 22

Comparison of the Dissociation Rate Constant and Dissociative Half-life of the Interaction of Monomeric SARS-COV-2 RBD-MMH (SEQ ID NO: 1069) to Anti-SARS-CoV-2 Monoclonal Antibodies at pH 7.4 and pH 5.0 at 37° C.

| mAb Captured | mAb Capture Level (RU) | RBD.mmh Bound at pH 7.4 (RU) | kd at pH 5.0 (1/s) | t½ at pH 5.0 (min) | mAb Capture Level (RU) | RBD.mmh Bound at pH 7.4 (RU) | Kd at pH 5.0 (1/s) | t½ at pH 5.0 (min) | t½ Ratio of pH 7.4 to pH 5.0 |
|---|---|---|---|---|---|---|---|---|---|
| mAb14284 | 386.5 | 146.9 | 6.24E−04 | 18.5 | 387.2 | 158.8 | 7.36E−04 | 15.7 | 1.2 |
| mAb14312 | 276.1 | 95.2 | 8.59E−04 | 13.5 | 274.5 | 96.7 | 5.58E−03 | 2.1 | 6.4 |
| mAb14294 | 222.4 | 83.2 | 9.20E−04 | 12.6 | 210.4 | 97.6 | 4.52E−04 | 25.5 | 0.5 |
| mAb14315 | 238 | 83.3 | 9.80E−04 | 11.8 | 228.3 | 101.2 | 7.00E−04 | 16.5 | 0.7 |
| mAb14292 | 241.2 | 73.4 | 1.41E−03 | 8.2 | 229.2 | 85 | 2.19E−03 | 5.3 | 1.5 |
| mAb14235 | 202.9 | 71.2 | 1.48E−03 | 7.8 | 184.9 | 80.8 | 1.19E−03 | 9.7 | 0.8 |
| mAb14247 | 137.5 | 40.8 | 1.58E−03 | 7.3 | 107.1 | 51.9 | 1.91E−03 | 6.1 | 1.2 |
| mAb13458 | 290.7 | 96.5 | 1.61E−03 | 7.2 | 270.3 | 90.9 | 4.01E−03 | 2.9 | 2.5 |
| mAb14283 | 246.6 | 87.7 | 1.69E−03 | 6.9 | 237.7 | 91.7 | 5.12E−03 | 2.3 | 3 |
| mAb14289 | 246.7 | 86.1 | 1.85E−03 | 6.2 | 235.5 | 89.3 | 4.60E−03 | 2.5 | 2.5 |
| mAb14260 | 208 | 74.5 | 1.88E−03 | 6.2 | 193.8 | 82.4 | 2.02E−03 | 5.7 | 1.1 |
| mAb14258 | 245.1 | 85.9 | 2.13E−03 | 5.4 | 230.8 | 103.4 | 5.08E−04 | 22.7 | 0.2 |
| mAb13457 | 309 | 103.3 | 2.14E−03 | 5.4 | 293.7 | 104.7 | 4.52E−03 | 2.6 | 2.1 |
| mAb14234 | 133.8 | 37.9 | 2.21E−03 | 5.2 | 98.5 | 40.4 | 1.66E−03 | 7 | 0.7 |
| mAb13459 | 301.6 | 106.8 | 2.29E−03 | 5.1 | 293.9 | 105.8 | 3.70E−03 | 3.1 | 1.6 |
| mAb14313 | 275.7 | 94.2 | 2.51E−03 | 4.6 | 265.2 | 80.8 | 5.73E−03 | 2 | 2.3 |
| mAb14255 | 288.4 | 97.5 | 4.93E−03 | 2.3 | 274.8 | 94.1 | 6.35E−03 | 1.8 | 1.3 |
| mAb14281 | 256.9 | 83.5 | 6.59E−03 | 1.8 | 241 | 51.7 | 1.17E−02 | 1 | 1.8 |
| mAb14230 | 224.5 | 67.6 | 7.71E−03 | 1.5 | 201.1 | 60.3 | 9.24E−03 | 1.3 | 1.2 |
| mAb14257 | 234.8 | 82.3 | 7.78E−03 | 1.5 | 224.7 | 45.2 | 1.72E−02 | 0.7 | 2.1 |
| mAb14286 | 259 | 84.3 | 9.68E−03 | 1.2 | 246.3 | 82.4 | 6.64E−03 | 1.7 | 0.7 |
| mAb14256 | 258.4 | 80.2 | 1.11E−02 | 1 | 239.7 | 54.1 | 9.27E−03 | 1.2 | 0.8 |
| mAb14282 | 215.3 | 73.5 | 1.26E−02 | 0.9 | 201.9 | 62.4 | 6.71E−03 | 1.7 | 0.5 |
| mAb14280 | 255 | 72.4 | 2.40E−02 | 0.5 | 241.4 | 61.7 | 1.03E−02 | 1.1 | 0.5 |
| mAb14285 | 213 | 64.2 | 2.58E−02 | 0.4 | 202 | 51.5 | 2.50E−03 | 4.6 | 0 |
| mAb14232 | 58.1 | 8.2 | 3.11E−02 | 0.4 | 22.3 | 10.1 | 6.56E−04 | 17.6 | 0 |
| mAb14259 | 233.1 | 12 | IC | IC | 214.1 | 1.8 | IC | IC | IC |
| mAb14314 | 255.1 | 5.8 | IC | IC | 252.9 | 3.4 | IC | IC | IC |
| mAb14231 | 272 | 0.1 | NB | NB | 249.9 | −1.3 | NB | NB | NB |
| mAb14233 | 197 | 1.7 | NB | NB | 173.5 | 6.6 | NB | NB | NB |
| mAb14248 | 230.5 | 0.9 | NB | NB | 210.3 | −0.8 | NB | NB | NB |
| mAb14249 | 215.1 | 0.2 | NB | NB | 198.6 | 1.9 | NB | NB | NB |
| mAb14287 | 254.4 | 1.1 | NB | NB | 240.6 | 0.3 | NB | NB | NB |
| mAb14288 | 216.2 | 0.9 | NB | NB | 203.7 | 4 | NB | NB | NB |
| mAb14290 | 245 | 0.3 | NB | NB | 228.9 | −0.6 | NB | NB | NB |
| mAb14291 | 200.5 | 0.9 | NB | NB | 188.5 | 3.2 | NB | NB | NB |
| mAb14293 | 257.1 | 1.4 | NB | NB | 243.1 | −0.2 | NB | NB | NB |
| mAb14295 | 259.7 | 2.1 | NB | NB | 250.3 | 8.7 | NB | NB | NB |
| mAb14296 | 276.5 | 1.7 | NB | NB | 267.7 | −1 | NB | NB | NB |
| mAb14297 | 229 | 2.2 | NB | NB | 218.2 | 3.1 | NB | NB | NB |
| mAb14316 | 201.7 | 2.1 | NB | NB | 181.3 | 0.9 | NB | NB | NB |
| mAb15156 | 268.5 | 92.6 | 6.73E−03 | 1.7 | 259.6 | 103.6 | 1.58E−02 | 0.7 | 2.3 |
| mAb15157 | 311.9 | 106.3 | 4.05E−03 | 2.9 | 301.7 | 107.5 | 7.02E−03 | 1.6 | 1.7 |
| mAb15158 | 306.9 | 111.4 | 3.10E−04 | 37 | 296.4 | 121.6 | 9.70E−05 | 118.9 | 0.3 |
| mAb15159 | 92.9 | 31.9 | 2.31E−04 | 50 | 73.6 | 45.5 | 4.29E−04 | 27 | 1.9 |
| mAb15160 | 178.8 | 58.2 | 2.18E−03 | 5.3 | 160.8 | 61.3 | 2.28E−03 | 5.1 | 1 |
| mAb15161 | 121.5 | 39.8 | 1.13E−03 | 10.3 | 100.8 | 51.4 | 9.80E−04 | 11.8 | 0.9 |
| mAb15162 | 330.8 | 116.4 | 3.00E−03 | 3.9 | 335.3 | 130.8 | 5.40E−03 | 2.1 | 1.8 |
| mAb15163 | 230.9 | 81.9 | 4.94E−04 | 23.4 | 221.3 | 83.2 | 3.77E−03 | 3.1 | 7.6 |
| mAb15164 | 400.6 | 144.9 | 2.26E−03 | 5.1 | 409.6 | 159 | 2.00E−03 | 5.8 | 0.9 |
| mAb15165 | 290.4 | 110 | 1.64E−03 | 7.1 | 289.5 | 126.8 | 9.73E−04 | 11.9 | 0.6 |
| mAb15166 | 244.5 | 65.2 | 3.00E−02 | 0.4 | 233.6 | 60 | 3.50E−02 | 0.3 | 1.2 |
| mAb15167 | 419.3 | 117.5 | 2.08E−02 | 0.6 | 422.4 | 126 | 1.33E−02 | 0.9 | 0.6 |
| mAb15170 | 309.8 | 120.5 | 1.07E−04 | 108.4 | 314.3 | 141.1 | 6.62E−05 | 174.4 | 0.6 |
| mAb15150 | 246.1 | 87.8 | 1.12E−04 | 103.4 | 236.7 | 92.6 | 1.00E−05 | 1155 | 0.1 |
| mAb15151 | 611.4 | 219.4 | 6.80E−03 | 1.7 | 632.9 | 230.7 | 4.39E−03 | 2.6 | 0.6 |
| mAb1932 | 314 | 0.6 | NB | NB | 305.2 | 1.9 | NB | NB | NB |

NB: No binding (NB) was observed under the current experimental conditions.
IC: Observed binding did not fit to the binding simulation model and no binding kinetic parameters were determined under the current experimental conditions.

Example 7: Cross-Competition Between Anti-SARS-CoV-2-S Antibodies

Binding competition between 41 anti-SARS-CoV-2-S monoclonal antibodies (mAbs) was determined using a real time, label-free bio-layer interferometry (BLI) assay on the Octet HTX biosensor platform (Pall ForteBio Corp.). The entire experiment was performed at 25° C. in a buffer containing 10 mM HEPES, 150 mM NaCl, 3 mM EDTA, 0.05% v/v Surfactant Tween-20, and 1 mg/mL BSA, pH7.4 (HBS-EBT) with the sample plate shaking at a speed of 1000 rpm. To assess whether mAbs compete with one another for binding to their respective epitopes on SARS-COV-2 RBD extracellular domain expressed with a C-terminal myc-myc-hexahistidine (SARS-COV-2 RBD-MMH; SEQ ID NO: 1069) tag, ~0.52-0.63 nm of SARS-COV-2 RBD-MMH was first captured onto anti-Penta-His antibody coated Octet biosensor tips (Fortebio Inc, #18-5122) by submerging the biosensor tips for 90 seconds in wells containing 10 μg/mL solution of SARS-COV-2 RBD-MMH. The SARS-COV-2 RBD-MMH captured biosensor tips were then saturated with a first anti-SARS-CoV-2 monoclonal antibody (mAb-1) by dipping into wells containing 50 μg/mL mAb-1 for 4 minutes. The tips were then submerged into wells containing 50 μg/mL of a second anti-SARS-CoV-2 monoclonal antibody (mAb-2) for 4 minutes. Between steps the tips were rinsed with HBS-ETB. The real-time binding response was monitored during the entire course of the experiment and the binding response at the end of every step was recorded. The response of mAb-2 binding to SARS-COV-2 RBD-MMH pre-complexed with mAb-1 was compared to the mAb-2 binding signal where the mAb-1 was a nonbinding isotype control, and the percentage reduction of mAb-2 binding was calculated. If pre-binding of mAb-1 resulted in a >50% reduction of mAb-2 binding, and reversing the order of binding for the mAb pair also exhibited >50% reduction in binding, mAb-1 and mAb-2 were classified as competing mAbs. FIG. 1 displays the results from cross-competition studies for anti-SARS-CoV-2 mAbs in a matrix format. Table 23 lists the competing mAbs for each anti-SARS-CoV-2 mAb included in the experiment.

TABLE 23

Cross-competing anti-SARS-CoV-2-S monoclonal antibodies upon binding to immobilized SARS-COV-2 RBD-MMH (SEQ ID NO: 1069)

| mAb-1 | mAb-2 Competing with mAb-1 |
|---|---|
| mAb14312 | mAb14256 |
|  | mAb14255 |
|  | mAb14257 |
|  | mAb14285 |
|  | mAb14286 |
|  | mAb14280 |
|  | mAb14282 |
|  | mAb14281 |
| mAb14256 | mAb14312 |
|  | mAb14286 |
|  | mAb14280 |
|  | mAb14282 |
|  | mAb14284 |
|  | mAb10985 |
| mAb14255 | mAb14312 |
|  | mAb14258 |
|  | mAb14257 |
|  | mAb14285 |
|  | mAb14286 |
|  | mAb14280 |
|  | mAb14282 |
| mAb10933 | mAb14258 |
|  | mAb14257 |
|  | mAb14285 |
|  | mAb14286 |
|  | mAb14280 |
|  | mAb14282 |
| mAb14258 | mAb14255 |
|  | mAb10933 |
|  | mAb14258 |
|  | mAb14257 |
|  | mAb14285 |
|  | mAb14286 |
|  | mAb14280 |
|  | mAb14282 |
|  | mAb14283 |
| mAb14257 | mAb14312 |
|  | mAb14255 |
|  | mAb10933 |
|  | mAb14258 |
|  | mAb14286 |
|  | mAb14280 |
|  | mAb14282 |
|  | mAb14313 |
|  | mAb14283 |
| mAb14285 | mAb14312 |
|  | mAb14255 |
|  | mAb10933 |
|  | mAb14258 |
|  | mAb14286 |
|  | mAb14280 |
|  | mAb14282 |
|  | mAb13457 |
|  | mAb13458 |
|  | mAb13459 |
|  | mAb14313 |
|  | mAb14283 |
|  | mAb10987 |
|  | mAb14289 |
| mAb14286 | mAb14312 |
|  | mAb14256 |
|  | mAb14255 |
|  | mAb10933 |
|  | mAb14258 |
|  | mAb14257 |
|  | mAb14285 |
|  | mAb14280 |
|  | mAb14282 |
|  | mAb13457 |
|  | mAb13458 |
|  | mAb13459 |
|  | mAb14313 |
|  | mAb14283 |
|  | mAb10987 |
|  | mAb14289 |
|  | mAb14260 |
| mAb14280 | mAb14312 |
|  | mAb14256 |
|  | mAb14255 |
|  | mAb10933 |
|  | mAb14258 |
|  | mAb14257 |
|  | mAb14285 |
|  | mAb14286 |
|  | mAb14282 |
|  | mAb14281 |
|  | mAb13457 |
|  | mAb13458 |
|  | mAb13459 |
|  | mAb14313 |
|  | mAb14283 |
|  | mAb10987 |
|  | mAb14289 |
| mAb14282 | mAb14312 |
|  | mAb14256 |
|  | mAb14255 |
|  | mAb10933 |
|  | mAb14258 |
|  | mAb14257 |
|  | mAb14285 |
|  | mAb14286 |
|  | mAb14280 |
|  | mAb14281 |
|  | mAb10987 |
|  | mAb14289 |
| mAb14281 | mAb14312 |
|  | mAb14280 |
|  | mAb14282 |
|  | mAb13457 |
|  | mAb13458 |
|  | mAb13459 |
|  | mAb14313 |
|  | mAb14283 |

TABLE 23-continued

Cross-competing anti-SARS-CoV-2-S monoclonal antibodies upon binding to immobilized SARS-COV-2 RBD-MMH (SEQ ID NO: 1069)

| mAb-1 | mAb-2 Competing with mAb-1 |
|---|---|
| mAb13457 | mAb10987 |
| | mAb14289 |
| | mAb14315 |
| | mAb14285 |
| | mAb14286 |
| | mAb14280 |
| | mAb14281 |
| | mAb13458 |
| | mAb13459 |
| | mAb14313 |
| | mAb14283 |
| | mAb10987 |
| | mAb14289 |
| | mAb14294 |
| | mAb14235 |
| | mAb14234 |
| | mAb14247 |
| | mAb14260 |
| | mAb14315 |
| | mAb14230 |
| | mAb14284 |
| mAb13458 | mAb14285 |
| | mAb14286 |
| | mAb14280 |
| | mAb14281 |
| | mAb13457 |
| | mAb13459 |
| | mAb14313 |
| | mAb14283 |
| | mAb10987 |
| | mAb14289 |
| | mAb14294 |
| | mAb14235 |
| | mAb14234 |
| | mAb14247 |
| | mAb14260 |
| | mAb14315 |
| | mAb14230 |
| | mAb14284 |
| mAb13459 | mAb14285 |
| | mAb14286 |
| | mAb14280 |
| | mAb14281 |
| | mAb13457 |
| | mAb13458 |
| | mAb14313 |
| | mAb14283 |
| | mAb10987 |
| | mAb14289 |
| | mAb14294 |
| | mAb14235 |
| | mAb14234 |
| | mAb14247 |
| | mAb14260 |
| | mAb14315 |
| | mAb14230 |
| | mAb14284 |
| mAb14313 | mAb14257 |
| | mAb14285 |
| | mAb14286 |
| | mAb14280 |
| | mAb14281 |
| | mAb13457 |
| | mAb13458 |
| | mAb13459 |
| | mAb14283 |
| | mAb10987 |
| | mAb14289 |
| | mAb14294 |
| | mAb14235 |
| | mAb14234 |
| | mAb14247 |
| | mAb14260 |
| | mAb14315 |
| | mAb14230 |
| | mAb14284 |
| mAb14283 | mAb14258 |
| | mAb14257 |
| | mAb14285 |
| | mAb14286 |
| | mAb14280 |
| | mAb14281 |
| | mAb13457 |
| | mAb13458 |
| | mAb13459 |
| | mAb14313 |
| | mAb10987 |
| | mAb14289 |
| | mAb14294 |
| | mAb14235 |
| | mAb14234 |
| | mAb14247 |
| | mAb14260 |
| | mAb14315 |
| | mAb14230 |
| | mAb14284 |
| mAb10987 | mAb14285 |
| | mAb14286 |
| | mAb14280 |
| | mAb14282 |
| | mAb14281 |
| | mAb13457 |
| | mAb13458 |
| | mAb13459 |
| | mAb14313 |
| | mAb14283 |
| | mAb14289 |
| | mAb14235 |
| | mAb14234 |
| | mAb14247 |
| | mAb14260 |
| | mAb14315 |
| | mAb14230 |
| | mAb14284 |
| mAb14289 | mAb14285 |
| | mAb14286 |
| | mAb14280 |
| | mAb14282 |
| | mAb14281 |
| | mAb13457 |
| | mAb13458 |
| | mAb13459 |
| | mAb14313 |
| | mAb14283 |
| | mAb10987 |
| | mAb14294 |
| | mAb14235 |
| | mAb14234 |
| | mAb14247 |
| | mAb14260 |
| | mAb14230 |
| | mAb14284 |
| mAb14294 | mAb13457 |
| | mAb13458 |
| | mAb13459 |
| | mAb14313 |
| | mAb14283 |
| | mAb14289 |
| | mAb14235 |
| | mAb14234 |
| | mAb14247 |
| | mAb14230 |
| | mAb14284 |
| mAb14235 | mAb13457 |
| | mAb13458 |
| | mAb13459 |
| | mAb14313 |
| | mAb14283 |

TABLE 23-continued

Cross-competing anti-SARS-CoV-2-S monoclonal antibodies upon binding to immobilized SARS-COV-2 RBD-MMH (SEQ ID NO: 1069)

| mAb-1 | mAb-2 Competing with mAb-1 |
|---|---|
| mAb14234 | mAb10987 |
| | mAb14289 |
| | mAb14294 |
| | mAb14234 |
| | mAb14247 |
| | mAb14260 |
| | mAb14315 |
| | mAb14230 |
| | mAb14284 |
| | mAb13457 |
| | mAb13458 |
| | mAb13459 |
| | mAb14313 |
| | mAb14283 |
| | mAb10987 |
| | mAb14289 |
| | mAb14294 |
| | mAb14235 |
| | mAb14247 |
| | mAb14260 |
| | mAb14315 |
| | mAb14230 |
| | mAb14284 |
| mAb14247 | mAb13457 |
| | mAb13458 |
| | mAb13459 |
| | mAb14313 |
| | mAb14283 |
| | mAb10987 |
| | mAb14289 |
| | mAb14294 |
| | mAb14235 |
| | mAb14234 |
| | mAb14260 |
| | mAb14315 |
| | mAb14230 |
| | mAb14284 |
| mAb14260 | mAb14286 |
| | mAb13457 |
| | mAb13458 |
| | mAb13459 |
| | mAb14313 |
| | mAb14283 |
| | mAb10987 |
| | mAb14289 |
| | mAb14235 |
| | mAb14234 |
| | mAb14247 |
| | mAb14315 |
| | mAb14230 |
| | mAb14284 |
| mAb14315 | mAb14281 |
| | mAb13457 |
| | mAb13458 |
| | mAb13459 |
| | mAb14313 |
| | mAb14283 |
| | mAb10987 |
| | mAb14235 |
| | mAb14234 |
| | mAb14247 |
| | mAb14260 |
| | mAb14230 |
| mAb14230 | mAb13457 |
| | mAb13458 |
| | mAb13459 |
| | mAb14313 |
| | mAb14283 |
| | mAb10987 |
| | mAb14289 |
| | mAb14294 |
| | mAb14235 |
| | mAb14234 |
| | mAb14247 |
| mAb14284 | mAb14260 |
| | mAb14315 |
| | mAb14284 |
| | mAb14256 |
| | mAb13457 |
| | mAb13458 |
| | mAb13459 |
| | mAb14313 |
| | mAb14283 |
| | mAb10987 |
| | mAb14289 |
| | mAb14294 |
| | mAb14235 |
| | mAb14234 |
| | mAb14247 |
| | mAb14260 |
| | mAb14230 |
| mAb10985 | mAb14256 |

Binding competition between 15 additional anti-SARS-Cov-2-S monoclonal antibodies was performed substantially as described above. Competition was determined using a real time, label-free bio-layer interferometry (BLI) assay on the Octet HTX biosensor platform (Pall ForteBio Corp.). The entire experiment was performed at 25° C. in a buffer containing 10 mM HEPES, 150 mM NaCl, 3 mM EDTA, 0.05% v/v Surfactant Tween-20, and 1 mg/mL BSA, pH7.4 (HBS-EBT) with the plate shaking at a speed of 1000 rpm. To assess whether mAbs are able to compete with one another for binding to their respective epitopes on SARS-COV-2 RBD extracellular domain expressed with a C-terminal myc-myc-hexahistidine (SARS-COV-2 RBD-MMH; SEQ ID NO: 1069) tag, ~0.51 nm of SARS-COV-2 RBD-MMH was first captured onto anti-Penta-His antibody coated Octet biosensor tips (Fortebio Inc, #18-5122) by submerging the biosensor tips for 90 seconds in wells containing 10 µg/mL of SARS-COV-2 RBD-MMH. The SARS-COV-2 RBD-MMH captured biosensor tips were then saturated with a first anti-SARS-CoV-2 monoclonal antibody (mAb-1) by dipping into wells containing 50 µg/mL mAb-1 for 4 minutes. The biosensor tips were then submerged into wells containing 50 µg/mL of a second anti-SARS-CoV-2 monoclonal antibody (mAb-2) for 4 minutes. Between steps the biosensor tips were rinsed with HBS-ETB buffer. The real-time binding response was monitored during the entire course of the experiment and the binding response at the end of every step was recorded. The response of mAb-2 binding to SARS-COV-2 RBD-MMH pre-complexed with mAb-1 was compared to the mAb-2 binding signal where the mAb-1 was a nonbinding isotype control, and the percentage reduction of mAb-2 binding was calculated. If pre-binding of mAb-1 resulted in >50% reduction of mAb-2 binding, and reversing the order of binding for the mAb pair also exhibited >50% reduction of binding, mAb-1 and mAb-2 were classified as competing mAbs. FIG. 2 displays the results from cross-competition studies for anti-SARS-Cov-2 mAbs in a matrix format. Table 24 lists the competing mAbs for each anti-SARS-CoV-2 mAb included in the experiment.

TABLE 24

Cross-competing anti-SARS-CoV-2-S monoclonal antibodies upon binding to immobilized SARS-COV-2 RBD-MMH (SEQ ID NO: 1069)

| mAb-1 | mAb-2 Competing with mAb-1 |
|---|---|
| mAb10934 | mAb10989 |
| | mAb15158 |
| | mAb15156 |
| | mAb15157 |
| | mAb15166 |
| | mAb15164 |
| | mAb15165 |
| | mAb15161 |
| | mAb15160 |
| | mAb10933 |
| | mAb15163 |
| | mAb14312 |
| | mAb14232 |
| | mAb10987 |
| | mAb14289 |
| | mAb14283 |
| | mAb14247 |
| | mAb14234 |
| | mAb14230 |
| | mAb14315 |
| | mAb14284 |
| | mAb14235 |
| | mAb14294 |
| mAb10989 | mAb10934 |
| | mAb15158 |
| | mAb15156 |
| | mAb15157 |
| | mAb15166 |
| | mAb15167 |
| | mAb15150 |
| | mAb10954 |
| | mAb15162 |
| | mAb15159 |
| | mAb15170 |
| | mAb15164 |
| | mAb15165 |
| | mAb15151 |
| | mAb15161 |
| | mAb15160 |
| | mAb10933 |
| | mAb15163 |
| | mAb14255 |
| | mAb14256 |
| | mAb14312 |
| | mAb10986 |
| | mAb10987 |
| | mAb14289 |
| | mAb14283 |
| mAb15158 | mAb10934 |
| | mAb10989 |
| | mAb15156 |
| | mAb15157 |
| | mAb15166 |
| | mAb15167 |
| | mAb15150 |
| | mAb10954 |
| | mAb15162 |
| | mAb15159 |
| | mAb15170 |
| | mAb15164 |
| | mAb15165 |
| | mAb15151 |
| | mAb15161 |
| | mAb15160 |
| | mAb10933 |
| | mAb15163 |
| | mAb14255 |
| | mAb14256 |
| | mAb14312 |
| | mAb10986 |
| | mAb10985 |
| | mAb14289 |
| mAb15156 | mAb10934 |
| | mAb10989 |
| | mAb15158 |
| | mAb15157 |
| | mAb15166 |
| | mAb15167 |
| | mAb15150 |
| | mAb10954 |
| | mAb15162 |
| | mAb15159 |
| | mAb15170 |
| | mAb15164 |
| | mAb15165 |
| | mAb15151 |
| | mAb15161 |
| | mAb15160 |
| | mAb10933 |
| | mAb15163 |
| | mAb14255 |
| | mAb14256 |
| | mAb14312 |
| | mAb10986 |
| | mAb14289 |
| | mAb14283 |
| mAb15157 | mAb10934 |
| | mAb10989 |
| | mAb15158 |
| | mAb15156 |
| | mAb15166 |
| | mAb15167 |
| | mAb15150 |
| | mAb10954 |
| | mAb15162 |
| | mAb15159 |
| | mAb15170 |
| | mAb15164 |
| | mAb15165 |
| | mAb15151 |
| | mAb15161 |
| | mAb15160 |
| | mAb10933 |
| | mAb15163 |
| | mAb14255 |
| | mAb14256 |
| | mAb14312 |
| | mAb10986 |
| | mAb10985 |
| | mAb14247 |
| mAb15166 | mAb10934 |
| | mAb10989 |
| | mAb15158 |
| | mAb15156 |
| | mAb15157 |
| | mAb15167 |
| | mAb15150 |
| | mAb10954 |
| | mAb15162 |
| | mAb15159 |
| | mAb15170 |
| | mAb15164 |
| | mAb15165 |
| | mAb15151 |
| | mAb15161 |
| | mAb15160 |
| | mAb10933 |
| | mAb15163 |
| | mAb14255 |
| | mAb14256 |
| | mAb14312 |
| | mAb10986 |
| mAb15167 | mAb10989mAb |
| | mAb15158 |
| | mAb15156 |
| | mAb15157 |
| | mAb15166 |
| | mAb15150 |

TABLE 24-continued

Cross-competing anti-SARS-CoV-2-S monoclonal antibodies upon binding to immobilized SARS-COV-2 RBD-MMH (SEQ ID NO: 1069)

| mAb-1 | mAb-2 Competing with mAb-1 |
|---|---|
| mAb15150 | mAb10954 |
| | mAb15162 |
| | mAb15159 |
| | mAb15170 |
| | mAb15164 |
| | mAb15165 |
| | mAb15151 |
| | mAb15161 |
| | mAb15160 |
| | mAb10933 |
| | mAb15163 |
| | mAb14255 |
| | mAb14256 |
| | mAb14312 |
| | mAb10986 |
| | mAb10989 |
| | mAb15158 |
| | mAb15156 |
| | mAb15157 |
| | mAb15166 |
| | mAb15167 |
| mAb10954 | mAb10954 |
| | mAb15162 |
| | mAb15170 |
| | mAb15164 |
| | mAb15165 |
| | mAb15151 |
| | mAb15161 |
| | mAb15160 |
| | mAb10933 |
| | mAb15163 |
| | mAb14255 |
| | mAb14256 |
| | mAb14312 |
| | mAb10986 |
| | mAb10985 |
| | mAb10989 |
| | mAb15158 |
| | mAb15156 |
| | mAb15157 |
| | mAb15166 |
| | mAb15167 |
| | mAb15150 |
| | mAb10954 |
| | mAb15162 |
| | mAb15159 |
| | mAb15170 |
| | mAb15164 |
| | mAb15165 |
| | mAb15151 |
| | mAb15161 |
| | mAb15160 |
| | mAb10933 |
| | mAb15163 |
| | mAb14255 |
| | mAb14256 |
| | mAb14312 |
| | mAb10986 |
| | mAb10985 |
| mAb15162 | mAb10989 |
| | mAb15158 |
| | mAb15156 |
| | mAb15157 |
| | mAb15166 |
| | mAb15167 |
| | mAb15150 |
| | mAb10954 |
| | mAb15159 |
| | mAb15170 |
| | mAb15164 |
| | mAb15165 |
| | mAb15151 |
| | mAb15161 |
| | mAb15160 |
| | mAb10933 |
| | mAb15163 |
| | mAb14255 |
| | mAb14256 |
| | mAb14312 |
| | mAb10986 |
| | mAb10985 |
| mAb15159 | mAb10989 |
| | mAb15158 |
| | mAb15156 |
| | mAb15157 |
| | mAb15166 |
| | mAb15167 |
| | mAb10954 |
| | mAb15162 |
| | mAb15170 |
| | mAb15164 |
| | mAb15165 |
| | mAb15151 |
| | mAb15161 |
| | mAb15160 |
| | mAb10933 |
| | mAb15163 |
| | mAb14255 |
| | mAb14256 |
| | mAb14312 |
| | mAb10986 |
| | mAb10985 |
| mAb15170 | mAb10989 |
| | mAb15158 |
| | mAb15156 |
| | mAb15157 |
| | mAb15166 |
| | mAb15167 |
| | mAb15150 |
| | mAb10954 |
| | mAb15162 |
| | mAb15159 |
| | mAb15164 |
| | mAb15165 |
| | mAb15151 |
| | mAb15161 |
| | mAb15160 |
| | mAb10933 |
| | mAb15163 |
| | mAb14255 |
| | mAb14256 |
| | mAb14312 |
| | mAb10986 |
| | mAb10985 |
| mAb15164 | mAb10934 |
| | mAb10989 |
| | mAb15158 |
| | mAb15156 |
| | mAb15157 |
| | mAb15166 |
| | mAb15167 |
| | mAb15150 |
| | mAb10954 |
| | mAb15162 |
| | mAb15159 |
| | mAb15170 |
| | mAb15165 |
| | mAb15151 |
| | mAb15161 |
| | mAb15160 |
| | mAb10933 |
| | mAb15163 |
| | mAb14255 |
| | mAb14256 |
| | mAb14312 |
| | mAb10986 |
| mAb15165 | mAb10989 |
| | mAb15158 |
| | mAb15156 |

TABLE 24-continued

Cross-competing anti-SARS-CoV-2-S monoclonal antibodies upon binding to immobilized SARS-COV-2 RBD-MMH (SEQ ID NO: 1069)

| mAb-1 | mAb-2 Competing with mAb-1 |
|---|---|
| | mAb15157 |
| | mAb15166 |
| | mAb15167 |
| | mAb15150 |
| | mAb10954 |
| | mAb15162 |
| | mAb15159 |
| | mAb15170 |
| | mAb15164 |
| | mAb15151 |
| | mAb15161 |
| | mAb15160 |
| | mAb10933 |
| | mAb15163 |
| | mAb14255 |
| | mAb14256 |
| | mAb14312 |
| | mAb10986 |
| mAb15151 | mAb10989 |
| | mAb15158 |
| | mAb15156 |
| | mAb15157 |
| | mAb15166 |
| | mAb15167 |
| | mAb15150 |
| | mAb10954 |
| | mAb15162 |
| | mAb15159 |
| | mAb15170 |
| | mAb15164 |
| | mAb15165 |
| | mAb15151 |
| | mAb15161 |
| | mAb15160 |
| | mAb10933 |
| | mAb15163 |
| | mAb14255 |
| | mAb14256 |
| | mAb14312 |
| | mAb10986 |
| mAb15161 | mAb10934 |
| | mAb10989 |
| | mAb15158 |
| | mAb15156 |
| | mAb15157 |
| | mAb15166 |
| | mAb15167 |
| | mAb15150 |
| | mAb10954 |
| | mAb15162 |
| | mAb15159 |
| | mAb15170 |
| | mAb15164 |
| | mAb15165 |
| | mAb15151 |
| | mAb15160 |
| | mAb10933 |
| | mAb15163 |
| | mAb14255 |
| | mAb14256 |
| | mAb14312 |
| | mAb10986 |
| mAb15160 | mAb10934 |
| | mAb10989 |
| | mAb15158 |
| | mAb15156 |
| | mAb15157 |
| | mAb15166 |
| | mAb15167 |
| | mAb15150 |
| | mAb10954 |
| | mAb15162 |
| | mAb15159 |
| | mAb15170 |

TABLE 24-continued

Cross-competing anti-SARS-CoV-2-S monoclonal antibodies upon binding to immobilized SARS-COV-2 RBD-MMH (SEQ ID NO: 1069)

| mAb-1 | mAb-2 Competing with mAb-1 |
|---|---|
| | mAb15164 |
| | mAb15165 |
| | mAb15151 |
| | mAb15161 |
| | mAb10933 |
| | mAb15163 |
| | mAb14255 |
| | mAb14256 |
| | mAb14312 |
| | mAb10986 |
| mAb10933 | mAb10934 |
| | mAb10989 |
| | mAb15158 |
| | mAb15156 |
| | mAb15157 |
| | mAb15166 |
| | mAb15167 |
| | mAb15150 |
| | mAb10954 |
| | mAb15162 |
| | mAb15159 |
| | mAb15170 |
| | mAb15164 |
| | mAb15165 |
| | mAb15151 |
| | mAb15161 |
| | mAb15160 |
| | mAb15163 |
| | mAb14255 |
| | mAb14256 |
| | mAb14312 |
| | mAb10986 |
| mAb15163 | mAb10934 |
| | mAb10989 |
| | mAb15158 |
| | mAb15156 |
| | mAb15157 |
| | mAb15166 |
| | mAb15167 |
| | mAb15150 |
| | mAb10954 |
| | mAb15162 |
| | mAb15159 |
| | mAb15170 |
| | mAb15164 |
| | mAb15165 |
| | mAb15151 |
| | mAb15161 |
| | mAb15160 |
| | mAb10933 |
| | mAb14255 |
| | mAb14256 |
| | mAb14312 |
| | mAb10986 |
| mAb14255 | mAb10989 |
| | mAb15158 |
| | mAb15156 |
| | mAb15157 |
| | mAb15166 |
| | mAb15167 |
| | mAb15150 |
| | mAb10954 |
| | mAb15162 |
| | mAb15159 |
| | mAb15170 |
| | mAb15164 |
| | mAb15165 |
| | mAb15151 |
| | mAb15161 |
| | mAb15160 |
| | mAb10933 |
| | mAb15163 |

TABLE 24-continued

Cross-competing anti-SARS-CoV-2-S monoclonal antibodies upon binding to immobilized SARS-COV-2

TABLE 24-continued

Cross-competing anti-SARS-CoV-2-S monoclonal antibodies upon binding to immobilized SARS-COV-2 RBD-MMH (SEQ ID NO: 1069)

| mAb-1 | mAb-2 Competing with mAb-1 |
|---|---|
| mAb14230 | mAb14315 |
|  | mAb14284 |
|  | mAb14235 |
|  | mAb14294 |
|  | mAb10934 |
|  | mAb14232 |
|  | mAb10987 |
|  | mAb14289 |
|  | mAb14283 |
|  | mAb14247 |
|  | mAb14234 |
| mAb14315 | mAb14315 |
|  | mAb14284 |
|  | mAb14235 |
|  | mAb14294 |
|  | mAb10934 |
|  | mAb14232 |
|  | mAb10987 |
|  | mAb14289 |
|  | mAb14283 |
|  | mAb14247 |
|  | mAb14234 |
|  | mAb14230 |
| mAb14284 | mAb14284 |
|  | mAb14235 |
|  | mAb14294 |
|  | mAb10934 |
|  | mAb14232 |
|  | mAb10987 |
|  | mAb14289 |
|  | mAb14283 |
|  | mAb14247 |
|  | mAb14234 |
|  | mAb14230 |
|  | mAb14315 |
| mAb14235 | mAb14235 |
|  | mAb14294 |
|  | mAb10934 |
|  | mAb14232 |
|  | mAb10987 |
|  | mAb14289 |
|  | mAb14283 |
|  | mAb14247 |
|  | mAb14234 |
|  | mAb14230 |
|  | mAb14315 |
|  | mAb14284 |
| mAb14294 | mAb14294 |
|  | mAb14232 |
|  | mAb10987 |
|  | mAb14289 |
|  | mAb14283 |
|  | mAb14247 |
|  | mAb14234 |
|  | mAb14230 |
|  | mAb14315 |
|  | mAb14284 |
|  | mAb14235 |

Example 8: Characterization of Anti-SARS-CoV-2-S mAbs in an ADCC Surrogate Assay (FcγR3a Val176 Signaling Assay)

The ability of antibodies targeting the spike protein of SARS-CoV-2 to interact with FcγR3a, an Fc-receptor prominently expressed on NK cells that induces antibody dependent cell-mediated cytotoxicity (ADCC), was measured in a surrogate bioassay using reporter cells and target cells bound to antibodies. In this assay, engineered Jurkat T cells expressed the reporter gene luciferase under the control of the transcription factor NFAT (NFAT-Luc) along with the high affinity human FcγR3a 176Val allotype receptor (Jurkat/NFAT-Luc/hFcγR3a 176Val). Target cells were engineered Jurkat T cells expressing human CD20 (used as a positive control with CD20 targeting human IgG1 antibody) alone or in combination with the full-length SARS-CoV-2 spike protein. Reporter cells were incubated with target cells, and engagement of FcγR3a via the Fc domain of human IgG1 antibodies bound to target cells led to the activation of the transcription factor NFAT in the reporter cells and drove the expression of luciferase which was then measured via a luminescence readout.

Target Cells

Jurkat/hCD20: Jurkat T cells were engineered to constitutively express full length human CD20 (amino acids M1-P297 of NCBI accession number NP_690605.1). Jurkat/hCD20 cells were stained for CD20 expression and maintained in RPMI+10% FBS+P/S/G+250 g/ml hygromycin growth medium. These cells were used as a negative control.

Jurkat/hCD20/ SARS-CoV-2 spike: Jurkat/hCD20 T cells were engineered to constitutively express full-length SARS-CoV-2 spike protein (amino acids M1-T1273 of NCBI accession number YP_009724390.1). Jurkat/hCD20/ SARS-CoV-2 spike cells were sorted for high expression of the spike protein and maintained in RPMI+10% FBS+P/S/G+1 µg/ml puromycin+250 g/ml hygromycin growth medium.

Reporter Cells

Jurkat/NFAT-Luc/FcγR3a 176Val: Jurkat T cells were engineered to stably express a Nuclear Factor of Activated T-cells (NFAT) luciferase reporter construct along with the high affinity human FcγR3a 176Val allotype receptor (amino acids M1-K254 of accession number P08637 VAR_003960). Engineered reporter cells were maintained in RPMI1640+10% FBS+P/S/G+0.5 µg/ml puromycin+500 µg/ml G418 growth media.

Assay Set-Up

One day before the experiment, Jurkat reporter cells were split to $7.5 \times 10^5$ cells/ml in RPMI1640+10% FBS+P/S/G+0.5 µg/ml puromycin+500 µg/ml G418 growth media. Jurkat target cells were split to $5 \times 10^5$ cells/ml in RPMI1640+10% FBS+P/S/G+0.5 µg/ml puromycin+250 µg/ml hygromycin growth media.

On the day of the experiment, the target and reporter cells were transferred into assay media (RPMI+10% FBS+P/S/G) and added at a 3:2 ratio ($3 \times 10^4$/well target cells and $2 \times 10^4$/well reporter cells) to 384-well white microtiter plates.

Anti-SARS-CoV-2 spike protein antibodies, a negative isotype-matched control antibody, and a positive control antibody for ADCC (anti-CD20) were titrated in an 11-point, 1:3 serial dilution ranging from 1.7 pM to 100 nM final concentration, with the final 12th point containing no antibody. All samples were tested in duplicates. Plates were incubated at 37° C./5% $CO_2$ for 5 h followed by the addition of an equal volume of ONE-Glo™ (Promega) reagent to lyse cells and detect luciferase activity. The emitted light was captured in Relative Light Units (RLU) on a multi-label plate reader Envision (PerkinElmer). EC50 values of the antibodies were determined from a 4 parameter logistic equation over a 12-point dose response curve (including the background signal) using GraphPad Prism software. Maximum fold induction was calculated using the following equation:

Fold Induction=Max Average RLU within tested dose range of each antibody/Average RLU (background signal=no antibody)

The EC50 values and fold inductions are summarized in Table 25.

Results with Jurkat/hCD20/ SARS-CoV-2 Spike Target Cells

Each of the tested anti-SARS-CoV-2-S antibodies showed greater fold induction than the negative control antibody. The EC50 values ranged from 60.4 pM to 3.4 nM, and the fold induction values ranged from 3.9× to 13.5×. The positive CD20 control antibody showed a fold induction of 29.9× with an EC50 value of 18.1 pM.

Results with Jurkat/hCD20 Target Cells

Each of the 41 anti-SARS-CoV-2-S antibodies except one (mAb14312) behaved similarly to the negative control antibody showing minimal activity. mAb14312 had an EC50 value of 18.4 nM and a fold induction value of 2.0. The positive CD20 control antibody showed a fold induction value of 29.4× with an EC50 value of 33.7 pM.

TABLE 25

Surrogate ADCC assay results

| | Jurkat CD20 | | Jurkat/CD20/spike | |
|---|---|---|---|---|
| mAb # | EC50 (M) | Fold induction | EC50 (M) | Fold induction |
| mAb13457 | ND | 1.2 | 1.50E−10 | 9.1 |
| mAb13458 | ND | 1.2 | 1.43E−10 | 10.2 |
| mAb13459 | ND | 1.2 | 1.42E−10 | 9.9 |
| mAb14230 | ND | 1.1 | 1.79E−10 | 9.8 |
| mAb14231 | ND | 1.2 | 3.25E−09 | 7.9 |
| mAb14232 | ND | 1.2 | 1.31E−10 | 10.8 |
| mAb14233 | ND | 1.1 | 2.80E−10 | 11.0 |
| mAb14234 | ND | 1.1 | 2.69E−10 | 12.6 |
| mAb14235 | ND | 1.0 | 1.43E−10 | 10.8 |
| mAb14247 | ND | 1.0 | 1.79E−10 | 11.3 |
| mAb14248 | ND | 1.0 | 1.79E−10 | 12.8 |
| mAb14249 | ND | 1.2 | 2.51E−10 | 10.3 |
| mAb14255 | ND | 1.0 | 1.67E−10 | 9.5 |
| mAb14256 | ND | 1.0 | 4.48E−10 | 6.1 |
| mAb14257 | ND | 1.0 | 2.39E−10 | 8.8 |
| mAb14258 | ND | 1.0 | 2.82E−10 | 7.5 |
| mAb14259 | ND | 1.0 | 3.94E−10 | 8.7 |
| mAb14260 | ND | 1.1 | 3.63E−10 | 6.0 |
| mAb14280 | ND | 1.1 | 2.67E−10 | 13.5 |
| mAb14281 | ND | 1.1 | 1.65E−10 | 10.3 |
| mAb14282 | ND | 1.1 | 2.57E−10 | 10.7 |
| mAb14283 | ND | 1.1 | 1.39E−10 | 9.1 |
| mAb14284 | ND | 1.1 | 1.56E−10 | 9.0 |
| mAb14285 | ND | 1.1 | 2.43E−10 | 11.0 |
| mAb14286 | ND | 1.0 | 2.04E−10 | 11.0 |
| mAb14287 | ND | 1.0 | 1.23E−09 | 6.2 |
| mAb14288 | ND | 1.0 | 5.10E−10 | 6.7 |
| mAb14289 | ND | 1.0 | 1.30E−10 | 6.3 |
| mAb14290 | ND | 1.0 | 3.42E−09 | 9.5 |
| mAb14291 | ND | 1.1 | 3.02E−10 | 9.7 |
| mAb14292 | ND | 1.0 | 3.86E−10 | 9.2 |
| mAb14293 | ND | 1.1 | 7.88E−10 | 9.3 |
| mAb14294 | ND | 1.0 | 6.04E−11 | 10.5 |
| mAb14295 | ND | 1.0 | 1.93E−10 | 11.5 |
| mAb14296 | ND | 1.0 | 4.11E−10 | 8.1 |
| mAb14297 | ND | 1.0 | 1.24E−10 | 7.9 |
| mAb14312 | 1.84E−08 | 2.0 | 1.68E−10 | 7.5 |
| mAb14313 | ND | 1.1 | 1.55E−10 | 7.1 |
| mAb14314 | ND | 1.1 | NC | 3.9 |
| mAb14315 | ND | 1.1 | 6.24E−11 | 9.3 |
| mAb14316 | ND | 1.0 | 1.89E−10* | 9.1 |
| mAb1932 - Negative Control | ND | 1.3 | ND | 1.5 |
| mAb2959 - Positive Control | 3.37E−11 | 29.4 | 1.81E−11 | 29.9 |

*At high concentrations the signal decreased (hook effect); points on the hook were removed prior to EC50 determination
NC: Not calculated because the data did not fit a 4-parameter logistic equation
ND: Not determined because a concentration-dependent response was not observed
Fold Induction = Max Average RLU within tested dose range of each antibody/Average RLU (background signal = no antibody)

From the initial mAbs tested, a select few were chosen for further follow-up to run alongside antibodies described in U.S. Pat. No. 10,787,501. The EC50 values and fold inductions are summarized in Table 26.

Results with Jurkat/hCD20/ SARS-CoV-2 Spike Target Cells

Each of the newly purified SARS-CoV-2 spike antibodies showed greater fold induction than the negative control antibody. The EC50 values of the newly purified SARS-CoV-2 spike antibodies ranged from 188 pM to 575 pM, and the fold induction values ranged from 2.0× to 3.2×. The positive CD20 control antibody showed a fold induction of 27.0× with an EC50 value of 51.8 pM.

Results with Jurkat/hCD20 Target Cells

Each of the newly purified SARS-CoV-2 spike antibodies behaved similarly to the negative control antibody showing minimal activity. By contrast, the positive CD20 control antibody showed a fold induction value of 23.5× with an EC50 value of 142 pM.

TABLE 26

Surrogate ADCC assay results

| | Jurkat CD20 | | Jurkat/CD20/spike | |
|---|---|---|---|---|
| mAb # or Name | EC50 (M) | Fold induction | EC50 (M) | Fold induction |
| mAb14255 | ND | 1.1 | 1.88E−10 | 3.2 |
| mAb14256 | ND | 1.1 | 5.75E−10 | 2.0 |
| mAb14257 | ND | 1.2 | 2.63E−10 | 2.2 |
| mAb14258 | ND | 1.2 | 2.06E−10 | 2.7 |
| mAb10984† | ND | 1.0 | 5.86E−10 | 1.3 |
| mAb10986† | ND | 1.0 | NC | 1.4 |
| mAb10964† | ND | 1.2 | 1.11E−10 | 1.8 |
| mAb10977† | ND | 1.3 | NC | 4.1 |
| mAb10933† | ND | 1.1 | 6.47E−10 | 2.9 |
| mAb10987† | ND | 1.0 | 4.71E−10 | 4.5 |
| mAb10989† | ND | 1.1 | 6.23E−10 | 6.5 |
| mAb1932 - Negative Control | ND | 1.2 | ND | 1.2 |
| mAb2959 - Positive Control | 1.42E−10 | 23.5 | 5.18E−11 | 27.0 |

†Antibody described in U.S. Pat. No. 10,787,501
NC: Not calculated because the data did not fit a 4-parameter logistic equation.
ND: Not determined because a concentration-dependent response was not observed
Fold Induction = Max Average RLU within tested dose range of each antibody/Average RLU (background signal = no antibody)

A subsequent round of testing on newly-purified antibodies was also performed. The EC50 values and fold inductions are summarized in Table 27.

Results with Jurkat/hCD20/ SARS-CoV-2 Spike Target Cells

Each of the newly purified anti-SARS-CoV-2-S antibodies showed greater fold induction than the negative control antibody. The EC50 values of the SARS-CoV-2 spike antibodies ranged from 81.7 pM to 905 pM, and the fold induction values ranged from 4.2× to 13.0×. The positive CD20 control antibody showed a fold induction of 46.7× with an EC50 value of 74.4 pM.

Results with Jurkat/hCD20 Target Cells

All the newly purified SARS-CoV-2-S antibodies behaved similarly to the negative control antibody, showing minimal activity. By contrast, the positive CD20 control antibody showed a fold induction value of 62.1× with an EC50 value of 145 pM.

TABLE 27

Surrogate ADCC assay results

| mAb # or Name | Jurkat CD20 | | Jurkat/CD20/spike | |
|---|---|---|---|---|
| | EC50 (M) | Fold induction | EC50 (M) | Fold induction |
| mAb15156 | ND | 1.1 | 3.47E–10 | 4.2 |
| mAb15157 | ND | 1.3 | 3.98E–10 | 4.8 |
| mAb15158 | ND | 1.2 | 3.81E–10 | 7.0 |
| mAb15159 | ND | 1.0 | 4.17E–10 | 5.0 |
| mAb15160 | ND | 1.2 | 2.98E–10 | 5.4 |
| mAb15161 | ND | 1.2 | 4.94E–10 | 5.9 |
| mAb15162 | ND | 1.1 | 9.05E–10 | 5.8 |
| mAb15163 | ND | 1.1 | 3.42E–10* | 8.2 |
| mAb15164 | ND | 1.2 | 2.23E–10* | 12.7 |
| mAb15165 | ND | 1.1 | 2.01E–10 | 13.0 |
| mAb15166 | ND | 1.1 | 8.17E–11 | 9.5 |
| mAb15167 | ND | 1.0 | 1.11E–10 | 7.3 |
| mAb15170 | ND | 1.0 | 6.26E–10 | 5.4 |
| mAb15150 | ND | 1.1 | 4.59E–10 | 5.2 |
| mAb15151 | ND | 1.4 | 3.51E–10 | 6.0 |
| mAb14255§ | ND | 1.1 | 1.37E–10 | 8.6 |
| mAb14256§ | ND | 1.0 | 2.63E–10 | 3.7 |
| mAb14315§ | ND | 1.0 | 9.96E–11* | 11.5 |
| mAb10985† | ND | 1.1 | 4.72E–10 | 3.7 |
| mAb10933† | ND | 1.0 | 8.76E–11 | 7.7 |
| mAb10987† | ND | 1.0 | 7.20E–11 | 10.2 |
| mAb1932 - Negative Control | ND | 1.2 | ND | 3.7 |
| mAb2959 - Positive Control | 1.45E–10 | 62.1 | 7.44E–11 | 46.7 |

†Antibody described in U.S. Pat. No. 10,787,501
§Antibody described in Table 25 and/or Table 26
*At high concentrations the signal decreased (hook effect); points on the hook were removed prior to EC50 determination
ND: Not determined because a concentration-dependent response was not observed
Fold Induction = Max Average RLU within tested dose range of each antibody/Average RLU (background signal = no antibody)

Example 9: Characterization of Anti-SARS-CoV-2-S mAbs in an ADCP Assay

The ability of antibodies targeting the spike protein of SARS-CoV-2 to induce phagocytosis of Jurkat cells engineered to express the SARS-CoV-2 full length spike protein was evaluated. Macrophages differentiated from monocytes in the presence of macrophage colony-stimulating factor (M-CSF) were used as effector cells in an antibody dependent cellular phagocytosis (ADCP) assay. An IgG1 isotype as a negative control was evaluated in parallel. Phagocytosis was assessed by measuring the number of fluorescently labeled target cells colocalizing with fluorescently labeled macrophages using an Opera Phenix High-Content Screening System.

Target Cells

Jurkat/hCD20/ SARS-CoV-2 spike: Jurkat T cells were engineered to constitutively express full length human CD20 (amino acids M1-P297 of NCBI accession number NP_690605.1) as well as full-length SARS-CoV-2 spike protein (amino acids M1-T1273 of NCBI accession number YP_009724390.1). Jurkat/hCD20/ SARS-CoV-2 spike cells were sorted for high expression of the spike protein and maintained in RPMI+10% FBS+P/S/G+1 µg/ml puromycin+250 µg/ml hygromycin growth medium.

Effector Cells

Macrophages differentiated from monocytes in the presence of M-CSF: Frozen CD14+ monocytes (Lonza) were thawed, resuspended in assay media (RPMI 1640 supplemented with 10% FBS, 100 U/ml penicillin, 100 µg/ml streptomycin, and 292 µg/ml L-glutamine, NaPyr, HEPES, and NEAA), supplemented with 100 ng/ml M-CSF, and plated at $5.2 \times 10^4$ cells/well into clear-bottom, collagen-coated 96-well black plates for differentiation into macrophages over 9 days.

Assay Set-Up

One day before the experiment, Jurkat target cells were split to $5 \times 10^5$ cells/ml in their respective growth media.

On the day of the experiment, target cells and monocyte-derived macrophages were incubated in PBS supplemented with either CellTrace CFSE dye or CellTrace Violet dye, respectively, for 15 minutes at 37° C., 5% $CO_2$.

CFSE-labeled target cells were washed and resuspended in assay media (RPMI 1640 supplemented with 10% FBS, 100 U/ml penicillin, 100 µm/ml streptomycin, and 292 µm/ml L-glutamine, NaPyr, HEPES, NEAA, and 10 µM BME) and added in duplicate to 96-well U-bottom plates at a density of $5 \times 10^4$ cells/well. Anti-SARS-CoV-2 spike and the IgG1 control antibodies were titrated in assay media in a 1:5 serial dilution ranging from 51 fM to 20 nM final concentration and added to the plates. The zero-antibody point was represented by 10 fM in GraphPad Prism.

After 15 minutes of incubation on ice the mixture of target cells, with or without titrated antibody, was then transferred to plates containing the violet-labelled macrophages and plates were incubated at 37° C., 5% CO2 for 30 minutes. Wells were washed with PBS 3 times, followed by addition of 4.21% formaldehyde in PBS supplemented with 2.5 µM DRAQ5.

After a 20 minute incubation, wells were washed with PBS and imaged in both the 488 nm (CFSE-labelled target cells) and 375 nm (violet-labelled macrophages) excitation channels using an Opera Phenix High-Content Screening System. Image analysis was performed in Harmony software. Image segmentation in the 375 nm excitation channel was used to identify the macrophage population. Image segmentation in the 488 nm excitation channel was used to identify the target cells. Phagocytosis was quantified by identifying the macrophage population which contained target cells within them.

Percent phagocytosis was calculated by comparing number of macrophages undergoing phagocytosis to total macrophage cell number.

$$\% \ ADCP = \frac{\text{Violet labelled macrophages containing } CFSE - \text{labelled target cells}}{\text{Total violet labelled macrophages}}$$

For $EC_{50}$ determinations, % ADCP was analyzed with GraphPad Prism using a 4-parameter logistic equation over a 10-point dose response curve, including the no antibody control. Maximum (Max) % ADCP was determined as the highest mean % ADCP value measured within tested dose range. The experiment was performed using a single donor in duplicate except for the following antibodies which were performed with no replicates: mAb10933, mAb10987, mAb10989, mAb1932, mAb10985, mAb14234, mAb10986, and mAb14259.

The $EC_{50}$ values and maximum (Max) % ADCP are summarized in Table 28.

Results with Jurkat/hCD20/ SARS-CoV-2 spike cells: Each of the 21 anti-SARS-CoV-2 spike antibodies showed greater Max % ADCP compared to IgG1 control antibody. The $EC_{50}$ values of the SARS-CoV-2 spike antibodies ranged from 5.22 pM to 1.12 nM, and Max % ADCP ranged from 16.72% to 39.89%.

TABLE 28

ADCP Activity

| Antibody treatment | ADCP | |
|---|---|---|
| | Max % ADCP | EC50 [M] |
| mAb10933† | 33.12 | 3.88E−11 |
| mAb10987† | 36.30 | 3.19E−11 |
| mAb10989† | 33.02 | 4.82E−11 |
| mAb1932 | 7.69 | ND |
| mAb10985† | 31.80 | 2.17E−10 |
| mAb14234 | 32.84 | 7.27E−11 |
| mAb14249 | 32.60 | 1.69E−10 |
| mAb14255 | 21.17 | 1.73E−11 |
| mAb14256 | 19.50 | NC |
| mAb14287 | 33.24 | NC |
| mAb14288 | 25.86 | 6.14E−10 |
| mAb14290 | 16.72 | NC |
| mAb14291 | 32.85 | 4.12E−10 |
| mAb14295 | 35.30 | 4.57E−10 |
| mAb14296 | 31.60 | 5.07E−10 |
| mAb14312 | 27.77 | 1.69E−11 |
| mAb14314 | 16.72 | 1.12E−09 |
| mAb14315 | 34.80 | 6.30E−11 |
| mAb14316 | 37.72 | 2.54E−10 |
| mAb10964† | 34.03 | 5.22E−12 |
| mAb10986† | 39.89 | 7.13E−11 |
| mAb14259 | 39.56 | NC |

†Antibody described in U.S. Pat. No. 10,787,501
ND: Not determined because a concentration-dependent response was not observed.
NC: Not calculated because the data did not fit a 4-parameter logistic equation.
Max (% ADCP) is the highest mean % ADCP value within tested dose range.

Example 10: Structure Determination of Antibody-Bound Spike Protein and Interactions To better understand the binding of mAb10987 and mAb14256 to the spike protein RBD, structural analysis was performed via cryo-electron microscopy (cryoEM). Fab fragments of mAb14256 and mAb10987 were isolated using FabALACTICA kit (Genovis). 25 μg of the mAb14256 Fab and 25 μg of mAb10987 Fab were mixed with 15 μg of SARS-CoV-2-S RBD and incubated on ice for 30 min. For cryoEM grid preparation, the protein sample was diluted to 0.94 mg/mL and 0.15% PMAL-C8 amphipol was added. 3 μL of protein was deposited onto a freshly plasma cleaned UltrAufoil grid (0.6/1.0, 300 mesh). Excess solution was blotted away using filter paper and plunge frozen into liquid ethane using a Vitrobot Mark IV. The cryoEM grid was transferred to a Titan Krios (Thermo Fisher) equipped with a K3 detector (Gatan). Movies were collected using EPU (Thermo Fisher) at 105,000× magnification, corresponding to a pixel size of 0.86 Å. A dose rate of 15 electrons per pixel per second was used and each movie was 2 seconds, corresponding to a total dose of ~40 electrons per Å$^2$.

All cryoEM data processing was carried out using cryoSPARC v3.2.0. 6,106 aligned micrographs were collected and 5,735 aligned micrographs were selected for further processing on the basis of estimated defocus values and CTF fit resolutions. An initial set of particles picked using blob picker were subjected to 2D classification to generate templates for template picking. ~1.4 million particles picked by template picking were subjected to multiple rounds of 2D classification to remove unbound Fabs and particles containing an incomplete complex. Ab initio reconstruction with three classes generated two classes containing 301,461 particles that corresponded to the full mAb10987 Fab-mAb14256 Fab-RBD complex. Heterogeneous refinement of those two classes was performed where one class showed a good quality map while the other showed high preferred orientation. Non-uniform refinement of the particles in the 'good' class containing 189,200 particles was followed by local refinement, resulting in a 3.86 Å resolution (FSC=0.143) map that was used for model building. Into this map, models of the RBD (taken from PDB code 6M0J) were manually placed and the two Fabs (taken from prior antibody structures, mAb10987 from PDB 6XDG and mAb14256 from another mAb14256 model). These models were then manually rebuilt using Coot and real-space refined against the map using Phenix.

Figure 4:
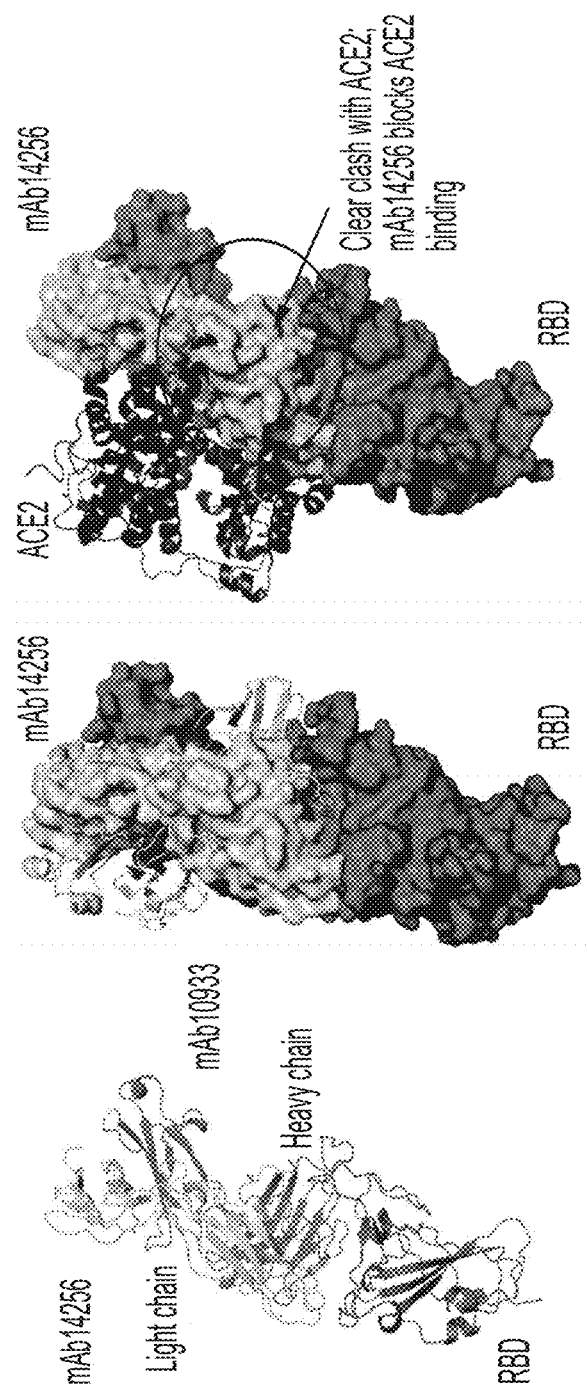
FIG. 4 shows that mAb14256 binds at the top of the RBD, thereby blocking ACE2 binding. mAb14256 competes with mAb10933 (middle structure) and mAb10985 (not depicted).

Confirming the above-described data, single-particle cryoEM of the complex of SARS-CoV-2 spike RBD bound to Fab fragments of mAb14256 and mAb10987 shows that the two antibodies in this cocktail can simultaneously bind to distinct regions of the RBD (FIG. 3, FIG. 4). A 3D reconstructed map of the complex with nominal resolution of 3.9 Å showed that both Fab fragments bound to non-overlapping regions on the surface of the RBD, confirming that they are non-competing antibodies. mAb14256 bound at the top of the RBD, extensively overlapping the binding site for ACE2. On the other hand, the epitope for mAb10987 was located on the side of the RBD, well away from the mAb14256 epitope, and had little to no overlap with the ACE2 binding site. The structure also revealed that mAb14256 competed with mAb10933 and mAb10985, although combinations of these antibodies still may be desirable because of different microepitope binding and the need to bind and neutralize different SARS-CoV-2 spike protein variants.

Figure 5:
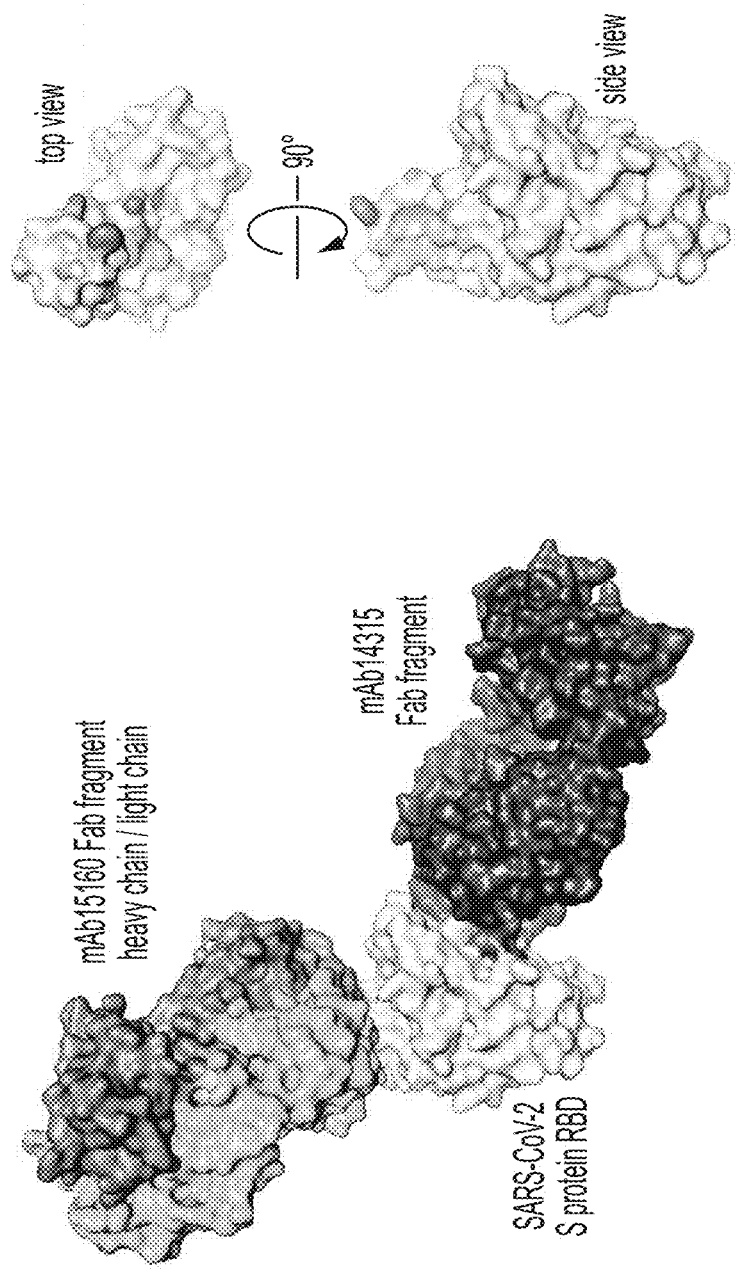
FIG. 5 depicts the cryo-EM structure of mAb15160, mAb14315, and the receptor binding domain (RBD) of the SARS-CoV-2 spike glycoprotein, in complex, at 3.18 Å resolution.

Using similar techniques, the structural basis for mAb15160 binding to SARS-CoV-2 RBD was investigated. Cryo-EM was used to determine the structure of the SARS-CoV-2 RBD in complex with the antigen-binding (Fab) fragments of mAb15160 and mAb14315. The resulting 3.18 Å-resolution structure revealed that mAb15160 binds to a small epitope on the top (i.e., closest to the target cell membrane) surface of the SARS-CoV-2 RBD (FIG. 5). Analysis of the binding interface between the SARS-CoV-2 RBD and the antibody Fab fragment indicate that the mAb15160 Fab contacts the RBD with both its heavy chain (13 residue-residue interactions) and light chain (13 residue-residue interactions). A total of 13 SARS-CoV-2 RBD residues are involved in mAb15160 binding. The functional impact of K417N, E484A, and Q493R, all of which are present in the Omicron variant, as well as other substitutions within the binding epitope, was assessed in neutralization studies discussed above. mAb15160 retained neutralization potency against the K417N and E484A individual mutations. There was an impact on the neutralization potency against the Q493R individual mutation (5-fold reduction compared with reference pseudoparticles); however, the neutralization potency of mAb15160 was within 1.5-fold against pseudoparticles pseudotyped with the full S protein sequence from the BA.1, BA.1.1, and BA.2 (Omicron) lineages compared with reference pseudoparticles.

Figure 6:
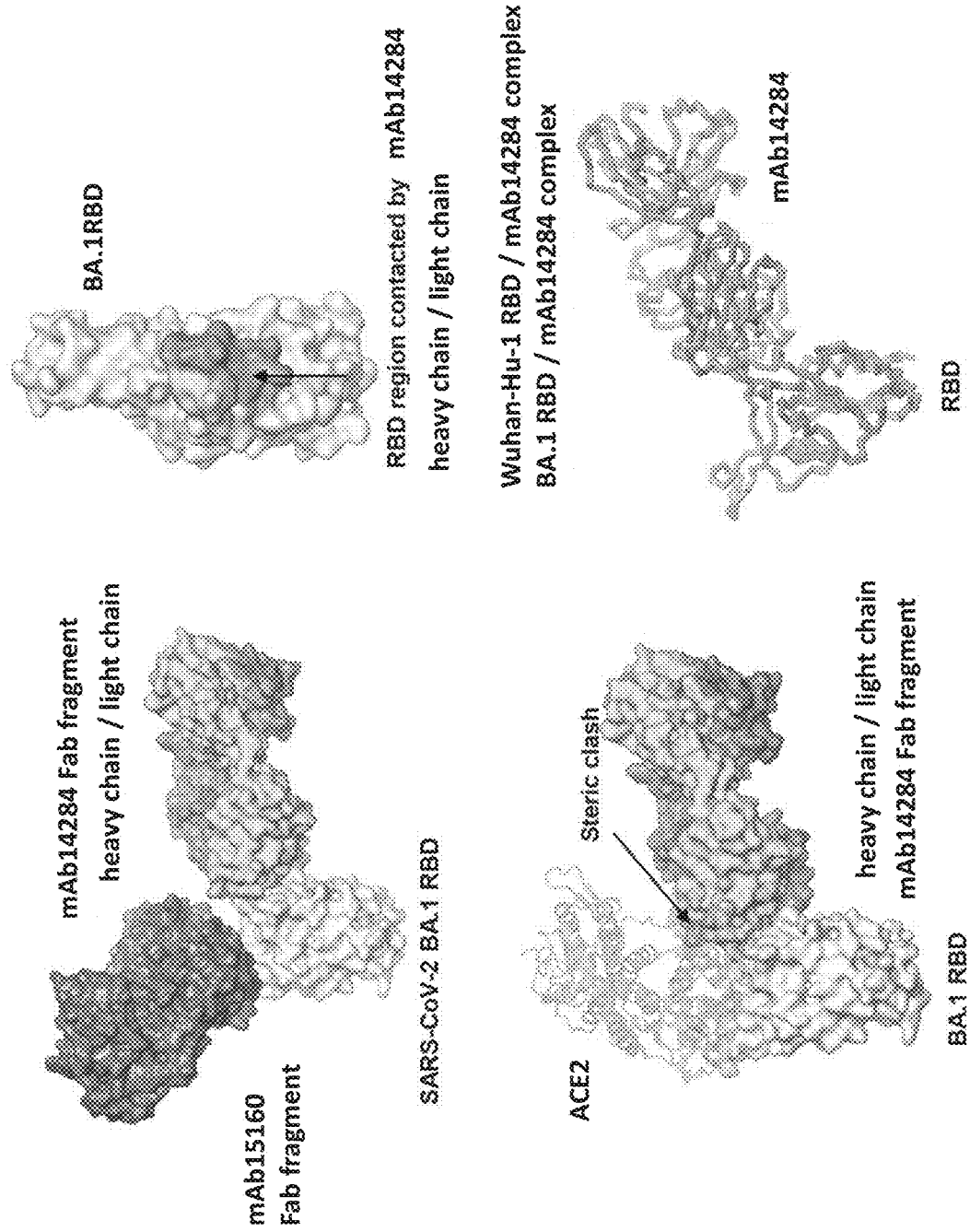
FIG. 6 depicts the cryo-EM structure of antigen-binding fragments of mAb1428 and mAb15160 with the receptor binding domain (RBD) from the Wuhan-Hu-1 strain and BA.1 lineage, in complex, at 3.3 and 3.4 Å resolution, respectively.

Using similar techniques, the structural basis for mAb14284 binding to SARS-CoV-2 Wuhan-Hu-1 and BA.1 (omicron lineage) RBDs was investigated. Cryo-EM was used to determine the structure of the antigen-binding (Fab) fragments of mAb14284 and mAb15160 with the RBD from the Wuhan-Hu-1 strain and BA.1 lineage. The resulting 3.3 and 3.4 Å-resolution structures, respectively, revealed that mAb14284 binds to an upper patch on both the Wu-1 and BA.1 RBD in a manner that is competitive with ACE2 binding (FIG. 6). Analysis of the binding interface between the mAb14284 Fab fragment and the SARS-CoV-2 RBDs from Wu-1 and BA.1 indicate that mAb14284 binds to the same location on the Wu-1 and BA.1 RBDs, with the same epitope residues except for 4 changes located at the periphery (Table 29, below). Epitope residues mutated in the BA.1 variant (N440K, G446S, Q498R, N501Y) relative to the ancestral Wu-1 strain are accommodated in the structure without major changes at the antibody-antigen interface.

mutations of K444. The K444L, K444M, K444N, K444Q, and K444T individual substitutions resulted in a >5-fold change compared with reference pseudoparticles; however, the neutralization potency of mAb14284 was within 1.5-fold against pseudoparticles pseudotyped with the most predominant (ie, 0.0141%) K444 variant, K444R (Table 19).

TABLE 29

Summary of Interactions between mAb14284 Fab Residues and SARS-CoV-2 RBD Residues

| Type of Interaction | Wuhan-Hu-1 RBD Residue | mAb 14284 Residue(s) Interacting with Indicated RBD Residue | | BA.1 RBD Residue | mAb14284 Residue(s) Interacting with Indicated RBD Residue | |
|---|---|---|---|---|---|---|
| | | Heavy Chain | Light Chain | | Heavy Chain | Light Chain |
| Hydrogen bond/salt bridge (<4 Å) | Asn439 | — | Tyr34 | — | — | — |
| | Lys444 | Trp55, Asp56 | — | Lys444 | Trp55 | — |
| | Val445 | Arg60 | — | — | — | — |
| | Gly447 | Arg60 | — | Gly447 | Arg60 | — |
| | Gln498* | — | Thr95 | Arg498* | — | Thr95 |
| | — | — | — | Thr500 | — | Val31 |
| Hydrophobic (<5 Å) | Asn440* | Ile102, Pro103 | — | Lys440* | Ile102, Pro103 | — |
| | Leu441 | Ser32, Gly33 | — | Leu441 | Ser32 | — |
| | Ser443 | Ile102 | — | Ser443 | Ile102 | — |
| | Lys444 | Tyr54, Trp55, Asp56, Asp58, Arg60, Ile102 | — | Lys444 | Tyr54, Trp55, Asp58, Ile102 | — |
| | Val445 | Trp49, Leu52, Tyr54, Arg60, His100 | Tyr93, Ser97, Thr98 | Val445 | Trp49, Leu52, Tyr54, Arg60, His100 | Tyr93, Ser97, Thr98 |
| | Gly446* | Arg60 | Ser96 | Ser446* | Arg60 | Ser96 |
| | Gly447 | Arg60 | — | Gly447 | Arg60 | — |
| | — | — | — | Tyr449 | Arg60 | — |
| | Gln498* | — | Thr95 | Arg498* | — | Thr95 |
| | Pro499 | Ile102 | Tyr34,Tyr93 | Pro499 | Ile102 | Tyr34,Tyr93 |
| | Thr500 | — | Leu29, Gly30, Tyr93, Thr94 | Thr500 | — | Leu29, Thr94, Tyr93, Thr95 |
| | Asn501* | — | Val31 | Tyr501* | — | Val31 |
| | Gly502 | — | Val31 | Gly502 | — | Val31 |

SARS-CoV-2 Wuhan-Hu-1 and BA.1 S protein RBD residues that interact with residues of the mAb14284 Fab heavy chain and light chain are indicated. A hyphen "—" indicates that no interaction was observed between the indicated RBD residue and the indicated antibody chain. Residues were selected based on the presence of hydrogen bonds/salt bridges with interatomic distances <4 Å (not including hydrogen atoms) or hydrophobic surfaces with interatomic distances <5 Å. An asterisk *indicates an RBD residue mutated in the BA (Omicron) lineages.

To assess the degree of variability of the mAb14284 epitope across currently circulating SARS-CoV-2 viruses, the sequences of 3,825,870 publicly available SARS-CoV-2 genomes identified between 1 Jan. 2022 and 16 Jun. 2022 (i.e., during the Omicron wave) were utilized. The sequences collected during this period likely consist mostly of Omicron sequences, however, other circulating variants, such as Delta, may also be included in this analysis.

Between 1 Jan. 2022 and 16 Jun. 2022, the RBD residues bound by mAb14284 were ≥99.96% conserved relative to the Wuhan-Hu-1 strain at each position, with the exception of 4 residues, N440, G446, Q498, and N501, which are mutated in the Omicron variant (i.e., BA lineages) (Table 30). The frequencies of N440, G446, Q498, and N501 across this monitoring period were 22, 59, 13, and 12%, respectively; instead, N440K, Q498R, and N501Y, all of which are present in the Omicron variant, had become predominant. While G446 remains the predominant residue during this period, 39% of sequences contain the G446S mutation, which is present in the BA.1 lineage of the Omicron variant The functional impact of N440K, G446S, Q498R, and N501Y, as well as other substitutions within the binding epitope identified during the conservation analysis (specified below in Table 30) was assessed in neutralization studies as discussed in Example 4. mAb14284 retained neutralization potency against all epitope residue variants tested except

TABLE 30

Summary of Frequencies of REGN14284 Epitope Variants Across Publicly Available SARS-CoV-2 Genomes from 1 Jan. 2022 through 16 Jun. 2022

| AA Position in RBD | Reference Sequence (Wuhan-Hu-1) | Observed Order of Frequency for Epitope Variants (High to Low) | | | |
|---|---|---|---|---|---|
| | | 1st | | 2nd | |
| | Residue | Freq (%) | Residue | Freq (%) | Residue | Freq (%) |
| 440 | N | 22.3472 | K | 78.1540 | del | 0.0026 |
| 441 | L | 99.9942 | del | 0.0025 | F | 0.0016 |
| 443 | S | 99.9964 | del | 0.0024 | N | 0.0002 |
| 444 | K | 99.9699 | R | 0.0141 | N | 0.0095 |
| 445 | V | 99.9834 | A | 0.0082 | I | 0.0033 |
| 446 | G | 58.9933 | S | 38.6232 | V | 0.0133 |
| 447 | G | 99.9948 | del | 0.0033 | S | 0.0005 |
| 449 | Y | 99.9643 | H | 0.0199 | N | 0.0137 |
| 498 | Q | 12.7255 | R | 87.5676 | L | 0.0115 |
| 499 | P | 99.9840 | del | 0.0095 | R | 0.0025 |
| 500 | T | 99.9832 | del | 0.0097 | S | 0.0031 |

TABLE 30-continued

Summary of Frequencies of REGN14284 Epitope Variants
Across Publicly Available SARS-CoV-2
Genomes from 1 Jan. 2022 through 16 Jun. 2022

| AA Position in RBD | Reference Sequence (Wuhan-Hu-1) Residue | Freq (%) | Observed Order of Frequency for Epitope Variants (High to Low) | | | |
|---|---|---|---|---|---|---|
| | | | 1st Residue | Freq (%) | 2nd Residue | Freq (%) |
| 501 | N | 12.3329 | Y | 87.9706 | del | 0.0101 |
| 502 | G | 99.9853 | del | 0.0104 | L | 0.0007 |

A total of 3,825,870 publicly available SARS-CoV-2 genome sequences identified Jan. 1, 2022 through Jun. 16, 2022 were analyzed against the reference (Wuhan-Hu-1) SARS-CoV-2 genome. The data collected during this period likely reflects mostly Omicron sequences, however, other circulating variants, such as Delta, may also be included in this analysis. The frequency (freq) of variants within the mAb14284 epitope (as determined by structural studies described herein) was calculated. The amino acid (AA) position indicates the residue in the SARS-CoV-2 S protein RBD (as displayed in Table 29). For each AA position within the epitope, the frequencies of reference residues and the 2 most frequent variant residues are shown. "Del" indicates a deletion at that AA position. The functional impact of the most predominant circulating epitope residue variants assessed through Jun. 16, 2022 (N439K, N439V, N440D, N440K, L441F, L441Q, K444L, K444M, K444N, K444Q, K444R, K444T, V445A, V445T, G446D, G446R, G446S, G446V, G447V, N448S, Y449D, Y449F, Y449H, Y449N, Y449S, Q498H, Q498R, T500A, T500F, T500N, N501T, N501Y) is summarized in Table 19.

Example 11: In Vitro VSV-SARS-CoV-2-S Virus Escape Mutant Selection in the Presence of mAb15160

To assess SARS-CoV-2 escape mutant selection, Vero cells were infected with replicating VSV-SARS-CoV-2-S (Wuhan-Hu-1 strain), and incubated with a range of concentrations of mAb15160 or IgG1 isotype control for 4 days. Infected cells were monitored for virus-induced cytopathic effect (CPE) as a read-out for virus replication. Loss of neutralization efficacy, as assessed by observable CPE in the presence of increasing concentration of antibodies, indicated potential selection of escape mutants. Supernatants containing virus were collected from wells with the highest mAb concentration and observable CPE, and further passaged in the presence of the same mAb. After passaging, supernatants containing virus were subjected to RNA sequence analysis and all amino acid changes in the S protein were designated as "putative escape mutations" if the amino acid change was present in anti-SARS-CoV-2 S protein mAb-treated samples, but neither in input virus (inoculum) nor control samples (IgG1 control or no-mAb control).

CPE at ≥90% was observed in the presence of 0.016 to 50 µg/mL mAb15160 within the first passage. Deep sequencing of viral genomes after the first passage under selection with mAb15160 identified 2 putative escape mutations in the SARS-CoV-2 RBD binding epitope for mAb15160-F486V and Y489H. Of note, neither of these individual mutations are found in the prominent Omicron and Delta variants or in any other prior variant of concern, indicating that there is no current clinical concern with respect to these mutations.

The functional impact of each putative escape mutant on mAb15160 activity was assessed in neutralization assays, as discussed above. F486V and Y489H reduced the neutralization activity of mAb15160 by >531-fold and 122-fold, respectively, compared with reference pseudoparticles, confirming that F486V and Y489H are escape mutants of mAb15160.

Example 12: In Vitro Effector Function Activities of mAb15160

The ability of mAb15160 to mediate antibody dependent cellular phagocytosis (ADCP) of fluorescently labeled target cells engineered to express full length (FL) SARS-CoV-2 S protein (Jurkat/hCD20/ SARS-CoV-2 S FL) was assessed in the presence of fluorescently-labeled primary MDM effector cells from two independent donors that were differentiated with macrophage colony-stimulating factor (MCSF). Results demonstrated that mAb15160 mediated concentration-dependent ADCP of Jurkat/hCD20/ SARS-CoV-2 S FL cells with $EC_{50}$ values in the picomolar range (Table 31), while no ADCP was observed with parental cells that did not express SARS-CoV-2 S protein. An IgG1 isotype control did not mediate ADCP of either Jurkat/hCD20/ SARS-CoV-2 S FL or Jurkat/hCD20 cell lines, whereas an anti-CD20 IgG1 control mediated ADCP of both Jurkat/hCD20/ SARS-CoV-2 S FL and Jurkat/hCD20 cell lines, demonstrating the capacity of effector cells used in the assay to phagocytose each of the tested cell lines.

TABLE 31

Summary of $EC_{50}$ and Maximum Phagocytosis Values for ADCP of Target Cells Mediated by mAb15160

| | MDM Donor #1 | | | | MDM Donor #2 | | | |
|---|---|---|---|---|---|---|---|---|
| | Jurkat/hCD20/ SARS-CoV-2 S FL | | Jurkat/hCD20 | | Jurkat/hCD20/ SARS-CoV-2 S FL | | Jurkat/hCD20 | |
| mAb(s) | $EC_{50}$ (M) | Max ADCP$^a$ (%) | $EC_{50}$ (M) | Max ADCP$^a$ (%) | $EC_{50}$ (M) | Max ADCP$^a$ (%) | $EC_{50}$ (M) | Max ADCP$^a$ (%) |
| mAb15160 | 7.81E−11 | 27.5 | ND | 14.7 | 4.76E−11 | 31.1 | ND | 11.1 |
| mAb10933 (casirivimab) | 9.70E−12 | 28.3 | ND | 14.0 | 2.23E−11 | 28.6 | ND | 11.5 |
| mAb10987 (imdevimab) | 2.91E−11 | 32.3 | ND | 14.8 | 1.98E−11 | 30.4 | ND | 10.7 |

TABLE 31-continued

Summary of EC$_{50}$ and Maximum Phagocytosis Values for ADCP of Target Cells Mediated by mAb15160

| | MDM Donor #1 | | | | MDM Donor #2 | | | |
|---|---|---|---|---|---|---|---|---|
| | Jurkat/hCD20/ SARS-CoV-2 S FL | | Jurkat/hCD20 | | Jurkat/hCD20/ SARS-CoV-2 S FL | | Jurkat/hCD20 | |
| mAb(s) | EC$_{50}$ (M) | Max ADCP$^a$ (%) | EC$_{50}$ (M) | Max ADCP$^a$ (%) | EC$_{50}$ (M) | Max ADCP$^a$ (%) | EC$_{50}$ (M) | Max ADCP$^a$ (%) |
| casirivimab + imdevimab | 1.20E−10 | 49.5 | ND | 15.5 | 5.78E−11 | 48.2 | ND | 15.1 |
| IgG1 isotype control | ND | 13.1 | ND | 16.9 | ND | 9.6 | ND | 14.6 |
| Anti-CD20 IgG1 | 1.01E−09 | 31.1 | 7.75E−10 | 45.4 | 1.49E−10 | 30.3 | 4.67E−10 | 45.2 |

$^a$Maximum (max) ADCP is defined as the highest mean percentage ADCP value observed within the concentration range tested (0 nM to 20 nM, where 0 nM is the no-antibody control).
ND, not determined because a concentration-dependent increase was not observed mAb15160 was evaluated for the ability to mediate antibody dependent cell-mediated cytotoxicity (ADCC) against Jurkat/hCD20/ SARS-CoV-2 S FL and Jurkat/hCD20 target cells using human primary natural killer (NK) cells from three independent donors as effector cells. Results demonstrate that mAb15160 mediates ADCC against Jurkat/hCD20/ SARS-CoV-2 S FL target cells, but not SARS-CoV-2-negative parental cells, with varying activity demonstrated with each NK donor (donor #3>donor #2; donor #1 showed no activity (Table 32). An IgG1 control did not mediate ADCC of either Jurkat/hCD20/ SARS-CoV-2 S FL or Jurkat/hCD20 cell lines, whereas a positive control, anti-CD20 IgG1, mediated ADCC of both Jurkat/hCD20/ SARS-CoV-2 S FL and Jurkat/hCD20 cell lines, demonstrating cytotoxic potential of all NK cells used in the assay against each tested cell line.

mAb15160 was evaluated for the ability to mediate the activation of FCGR3A signaling in a surrogate ADCC reporter bioassay using Jurkat T cells engineered to express a nuclear factor of activated T cells-luciferase (NFAT-Luc) reporter gene and human FCGR3A (Jurkat/NFAT-Luc/FCGR3A) in the presence of Jurkat/hCD20/ SARS-CoV-2 S FL target cells. Engagement of FCGR3A via the Fc domain of human IgG1 antibodies bound to target cells leads to the activation of NFAT and drives the expression of luciferase, which is then measured via a luminescence readout. In agreement with results from ADCC assays using primary NK cells, results from the ADCC-surrogate reporter assay demonstrate that mAb15160 mediates a concentration-dependent increase in luciferase activity from reporter cells expressing FCGR3A in the presence of Jurkat/hCD20/ SARS-CoV-2 S FL target cells with an EC$_{50}$ of $2.97 \times 10^{-10}$

TABLE 32

Summary of EC$_{50}$ and Maximum Cytotoxicity Values for ADCC Against Target Cells Mediated by mAb15160

| | NK Donor #1 | | | | NK Donor #2 | | | | NK Donor #3 | | | |
|---|---|---|---|---|---|---|---|---|---|---|---|---|
| | Jurkat/hCD20/ SARS-CoV-2 S FL | | Jurkat/hCD20 | | Jurkat/hCD20/ SARS-CoV-2 S FL | | Jurkat/hCD20 | | Jurkat/hCD20/ SARS-CoV-2 S FL | | Jurkat/hCD20 | |
| mAb(s) | EC$_{50}$ (M) | Max Cytotoxicity$^a$ (%) | EC$_{50}$ (M) | Max Cytotoxicity$^a$ (%) | EC$_{50}$ (M) | Max Cytotoxicity$^a$ (%) | EC$_{50}$ (M) | Max Cytotoxicity$^a$ (%) | EC$_{50}$ (M) | Max Cytotoxicity$^a$ (%) | EC$_{50}$ (M) | Max Cytotoxicity$^a$ (%) |
| mAb15160 | ND | 1.8 | NC | 4.6 | NC | 6.3 | ND | 3.1 | 6.32E−11 | 12.9 | ND | 0.0 |
| mAb10933 (casirivimab) | ND | 1.4 | NC | 4.7 | NC | 5.0 | NC | 3.6 | 4.89E−11 | 11.1 | ND | 1.2 |
| mAb 10987 (imdevimab) | 7.42E−10 | 8.1 | NC | 3.9 | 5.05E−09 | 10.5 | ND | 1.9 | 6.44E−11 | 26.6 | ND | 1.3 |
| casirivimab + imdevimab | ND | 1.6 | ND | 0.8 | NC | 4.1 | ND | 4.8 | 3.60E−11 | 15.4 | ND | 0.0 |
| IgG1 isotype control | ND | 1.8 | ND | 0.7 | ND | 0.0 | NC | 6.4 | ND | 0.0 | ND | 0.5 |
| Anti-CD20 IgG1 | 2.63E−12 | 20.0 | 3.03E−12 | 21.0 | 8.19E−12 | 15.1 | 8.08E−13 | 26.8 | 3.53E−14 | 14.5 | NC | 37.7 |

$^a$Maximum (max) cytotoxicity is defined as the highest mean percentage cytotoxicity value observed within the concentration range tested
NC, Not calculated because the data did not fit a 4-parameter logistic equation; ND, Not determined because a concentration-dependent increase was not observed.

M. The IgG1 negative control did not activate FCGR3A in the presence of Jurkat/hCD20/ SARS-CoV-2 S FL or Jurkat/hCD20 cell lines.

mAb15160 was evaluated for the ability to mediate CDC against Jurkat/hCD20/ SARS-CoV-2 S FL and Jurkat/hCD20 target cells in the presence of 5% pooled (i.e., from several donors) NHS. Results demonstrate that mAb15160 does not mediate CDC against Jurkat/hCD20/ SARS-CoV-2 S FL or Jurkat/hCD20 cells in the presence of 5% NHS at antibody concentrations ranging from 0.95 pM to 1 μM. NHS used in the assay was evaluated in the same target cell lines for the ability to mediate CDC using the positive control, anti-CD20 IgG1. In the presence of NHS, the anti-CD20 IgG1 mediated CDC against target cell lines in a concentration-dependent manner. In the absence of NHS, the anti-CD20 IgG1 did not mediate lysis against any of the tested target cell lines.

Example 13: In Vitro VSV-SARS-CoV-2-S Virus Escape Mutant Selection in the Presence of mAb14284

To assess SARS-CoV-2 escape mutant selection, Vero cells were infected with replicating pseudotyped VSV-SARS-CoV-2-S (Wuhan-Hu-1 strain) and incubated with a range of concentrations of mAb14284 or IgG1 isotype control for 4 days. Infected cells were monitored for virus-induced cytopathic effect (CPE) as a read-out for virus replication. Loss of neutralization efficacy, as assessed by observable CPE in the presence of increasing concentration of antibodies, indicated potential selection of escape mutants. Supernatants containing virus were collected from wells with the highest mAb concentration and observable CPE, and further passaged in the presence of the same mAb. After passaging, supernatants containing virus were subjected to RNA sequence analysis and all amino acid changes in the S protein were designated as "putative escape mutations" if the amino acid change was present in the mAb14284-treated sample, but not in the IgG1 control sample.

CPE at ≥90% was observed in the presence of 0.016 to 50 μg/mL mAb14284 within the first passage (Table 33). Deep sequencing of viral genomes after the first passage under selection with mAb14284 identified 3 putative escape mutations in the SARS-CoV-2 RBD binding epitope for REGN14284-K444E, K444N, and V445D (Table 34).

The functional impact of putative escape mutant, K444N, on mAb14284 activity was assessed in neutralization assays discussed in Example 4. The K444N variant resulted in a complete loss of mAb14284 neutralization activity compared with reference pseudoparticles (Table 19), confirming that K444N is an escape mutant of mAb14284.

Functional assays of K444E and V445D are ongoing. However, the K444L, K444M, K444N, K444Q, K444T, V445A, and V445T mutations all resulted in a reduction or complete loss of mAb14284 neutralization activity; mAb14284 neutralization activity was retained against the K444R mutation (Table 19).

TABLE 33

Selection of Putative VSV-SARS-CoV-2-S Virus Escape Mutants

| | CPE (%) | | | | | | |
|---|---|---|---|---|---|---|---|
| Antibody | 50 μg/mL | 10 μg/mL | 2 μg/mL | 0.4 μg/mL | 0.08 μg/mL | 0.016 μg/mL | No mAb |
| | Passage 1 | | | | | | |
| mAb14284 | ≥90 | >90 | >90 | >90 | >90 | >90 | >90 |
| IgG1 Control | ≥90 | >90 | >90 | >90 | >90 | >90 | ≥90 |

Vero cells were infected with VSV-SARS-CoV-2-S virus in the presence of mAb14284 or IgG1 isotype control mAb at a range of concentrations (0.016 to 50 μg/mL total) for 4 days. Cells were screened for virus replication by monitoring for virus-induced CPE. Supernatants containing virus were collected from wells with the highest antibody concentrations and detectable viral replication (≥20% CPE). Deep sequencing of viral RNA from was performed to determine the identity of putative escape mutations. A no antibody control (0 μg/mL) was sequenced to monitor for tissue culture adaptation. Bold, underlined text indicates samples that were sequenced.

TABLE 34

Deep Sequencing of Passaged Virus Identifies Putative Escape Mutations in the Receptor Binding Domain

| Genomic position | 4407 | 4409 | 4411 |
|---|---|---|---|
| Reference nucleotide | A | G | T |
| Variant nucleotide | G | T | A |
| Gene position | 1330 | 1332 | 1334 |
| Mutation nature | nSNP | nSNP | nSNP |
| AA position | 444 | 444 | 445 |
| Reference AA | K | K | V |
| Variant AA | E | N | D |
| Inoculum | 0% | 0% | 0% |
| mAb14284 | 7% | 19% | 67% |
| IgG1 Isotype Control | 0% | 0% | 0% |
| No Ab | 0% | 0% | 0% |

Viral RNA from wells with the highest mAb concentration that showed detectable CPE was isolated 4 days post-infection. Deep sequencing was performed to identify changes in S protein sequence relative to the Wuhan-Hu-1 reference sequence. Only RBD variants are summarized in this table.

Example 14: In Vitro Effector Function Activities of mAb14284

IgG antibodies that are bound to target cells can mediate effector functions via their constant (Fc) region by interacting with specific FCGRs expressed on macrophages and natural killer (NK) cells, leading to antibody-dependent cellular phagocytosis (ADCP) and antibody-dependent cellular cytotoxicity (ADCC), respectively, or by binding to complement proteins, leading to complement-dependent cytotoxicity (CDC), resulting in the destruction of target cells.

A series of in vitro studies was conducted to assess the ability of mAb14284 to mediate ADCP, ADCC, and CDC against target cells expressing full-length (FL) SARS-CoV-2 S protein from the Wuhan-Hu-1 strain (AA 1-1273), and BA.1 and BA.2 omicron lineages (AA 1-1270). To allow for simultaneous testing of an anti-CD20 IgG1 positive control antibody, target cell lines were also engineered to stably express human CD20 (hCD20).

Specifically, mAb14284 was assessed for the ability to: 1) mediate ADCP of target cells using monocyte-derived macrophages (MDM) as effector cells; 2) mediate ADCC of target cells using primary natural killer (NK) cells as effector cells; 3) activate FCGR3A signaling in an ADCC-surrogate reporter assay; and 4) mediate CDC of target cells in the presence of normal human serum (NHS).

The ability of mAb14284 to mediate ADCP of fluorescently labeled Jurkat/hCD20 target cells expressing FL Wu-1, BA.1, or BA.2 S protein was assessed in the presence of fluorescently labeled primary MDM effector cells from two independent donors that were differentiated with macrophage colony-stimulating factor (MCSF). mAb14284 mediates concentration-dependent ADCP of Jurkat/hCD20 cells expressing SARS-CoV-2 Wu-1, BA.1, or BA.2 S protein with $EC_{50}$ values in the picomolar range (Table 35), while no ADCP was observed with parental cells that do not express SARS-CoV-2 S protein. An IgG1 isotype control did not mediate ADCP of any of the tested cell lines, whereas an anti-CD20 IgG1 control mediated ADCP of all tested cell lines, demonstrating the capacity of effector cells used in the assay to phagocytose each cell line evaluated.

TABLE 35

Summary of $EC_{50}$ and Maximum Phagocytosis Values for ADCP of Target Cells Mediated by mAb14284

| mAb(s) | Jurkat/hCD20/SARS-CoV-2 Wu-1 S | | Jurkat/hCD20/SARS-CoV-2 BA.1 S | | Jurkat/hCD20/SARS-CoV-2 BA.2 S | | Jurkat/hCD20 | |
|---|---|---|---|---|---|---|---|---|
| | $EC_{50}$ (M) | Max ADCP[a] (%) | $EC_{50}$ (M) | Max ADCP[a] (%) | $EC_{50}$ (M) | Max ADCP[a] (%) | $EC_{50}$ (M) | Max ADCP[a] (%) |
| MDM Donor #1 | | | | | | | | |
| mAb14284 | NC | 38.6 | 3.11E−11 | 44 | 4.37E−11 | 46.5 | ND | 0 |
| IgG1 isotype control | 8.78E−11 | 45.5 | 7.97E−11 | 61.5 | 2.30E−10 | 37.4 | 1.77E−10 | 54.9 |
| Anti-CD20 IgG1 | ND | 2 | ND | 4.4 | ND | 4.1 | ND | 4.5 |
| MDM Donor #2 | | | | | | | | |
| mAb14284 | 1.64E−11 | 49.7 | 3.73E−11 | 60.9 | 8.74E−11 | 43.8 | ND | 0 |
| IgG1 isotype control | 8.10E−11 | 87.3 | 8.21E−11 | 80.4 | 2.23E−10 | 22.5 | 3.18E−10 | 37.9 |
| Anti-CD20 IgG1 | ND | 7.4 | ND | 1.5 | ND | 0 | ND | 0 |

[a]Maximum (max) ADCP is defined as the highest mean percentage ADCP value observed within the concentration range tested (0 nM to 20 nM, where 0 nM is the no-antibody control).
NC, Not calculated because the data did not fit a 4-parameter logistic equation; ND, not determined because a concentration-dependent increase was not observed mAb14284 was evaluated for the ability to mediate ADCC against Jurkat/hCD20 target cells expressing FL Wu-1, BA.1, or BA.2 S protein using human primary NK cells pooled from 3 donors as effector cells. Results demonstrate that mAb14284 mediates concentration-dependent ADCC against Jurkat/hCD20 expressing SARS-CoV-2 Wu-1, BA.1, or BA.2 S protein with $EC_{50}$ values in the picomolar range (Table 36), but not against parental cells that do not express SARS-CoV-2 S protein. An IgG1 control did not mediate ADCC against any of the tested cell lines, whereas a positive control, anti-CD20 IgG1, mediated ADCC against all tested cell lines, demonstrating cytotoxic potential of the NK cells used in the assay against each cell line evaluated.

TABLE 36

Summary of $EC_{50}$ and Maximum Cytotoxicity Values for ADCC Against Target Cells Mediated by REGN14284

| mAb(s) | Jurkat/hCD20/ SARS-CoV-2 Wu-1 S | | Jurkat/hCD20/ SARS-CoV-2 BA.1 S | | Jurkat/hCD20/ SARS-CoV-2 BA.2 S | | Jurkat/hCD20 | |
|---|---|---|---|---|---|---|---|---|
| | $EC_{50}$ (M) | Max Cytotoxicity[a] (%) | $EC_{50}$ (M) | Max Cytotoxicity[a] (%) | $EC_{50}$ (M) | Max Cytotoxicity[a] (%) | $EC_{50}$ (M) | Max Cytotoxicity[a] (%) |
| mAb14284 | 6.41E−12 | 7.9 | 2.64E−11 | 8.3 | 5.37E−12 | 8.3 | ND | 0.4 |
| IgG1 isotype control | ND | 0.6 | ND | 0.2 | ND | 0.6 | ND | 0.6 |

TABLE 36-continued

Summary of $EC_{50}$ and Maximum Cytotoxicity Values for ADCC Against Target Cells Mediated by REGN14284

| mAb(s) | Jurkat/hCD20/ SARS-CoV-2 Wu-1 S | | Jurkat/hCD20/ SARS-CoV-2 BA.1 S | | Jurkat/hCD20/ SARS-CoV-2 BA.2 S | | Jurkat/hCD20 | |
|---|---|---|---|---|---|---|---|---|
| | $EC_{50}$ (M) | Max Cytotoxicity[a] (%) | $EC_{50}$ (M) | Max Cytotoxicity[a] (%) | $EC_{50}$ (M) | Max Cytotoxicity[a] (%) | $EC_{50}$ (M) | Max Cytotoxicity[a] (%) |
| Anti-CD20 IgG1 | 5.83E−12 | 16.9 | 3.03E−12 | 18.8 | 1.49E−11 | 18.7 | 1.17E−11 | 15.1 |

[a]Maximum (max) cytotoxicity is defined as the highest mean percentage cytotoxicity value observed within the concentration range tested
NC, Not calculated because the data did not fit a 4-parameter logistic equation; ND, Not determined because a concentration-dependent increase was not observed.

mAb14284 was evaluated for the ability to mediate the activation of FCGR3A signaling in a surrogate ADCC reporter bioassay using Jurkat T cells engineered to express a nuclear factor of activated T cells-luciferase (NFAT-Luc) reporter gene and human FCGR3A (Jurkat/NFAT-Luc/FCGR3A) in the presence of Jurkat/hCD20 target cells expressing FL SARS-CoV-2 Wu-1, BA.1, or BA.2 S protein. Engagement of FCGR3A via the Fc domain of human IgG1 antibodies bound to target cells leads to the activation of NFAT and drives the expression of luciferase, which is then measured via a luminescence readout.

In agreement with results from ADCC assays using primary NK cells, results from the ADCC-surrogate reporter assay demonstrate that mAb14284 mediates a concentration-dependent increase in luciferase activity from reporter cells expressing FCGR3A in the presence of SARS-CoV-2 Wu-1, BA.1, or BA.2 S protein-expressing target cells with picomolar $EC_{50}$ values, but not against parental cells that do not express SARS-CoV-2 S protein. The IgG1 negative control did not activate FCGR3A in the presence of any cell line evaluated.

mAb14284 was evaluated for the ability to mediate CDC against Jurkat/hCD20/ SARS-CoV-2 Wu-1 S, Jurkat/hCD20/ SARS-CoV-2 BA.1 S, Jurkat/hCD20/ SARS-CoV-2 BA.2 S, and Jurkat/hCD20 target cells in the presence of 5% pooled (i.e., from several donors) NHS. Results demonstrate that mAb14284 did not mediate CDC against parental Jurkat/hCD20 cells, nor Jurkat/hCD20 cells expressing full-length SARS-CoV-2 Wu.1, BA.1, or BA.2 S protein in the presence of 5% NHS at antibody concentrations ranging from 0.95 pM to 1 µM.

NHS used in the assay was evaluated in the same target cell lines for the ability to mediate CDC using the positive control, anti-CD20 IgG1. In the presence of NHS, the anti-CD20 IgG1 mediated CDC against target cell lines in a concentration-dependent manner. In the absence of NHS, the anti-CD20 IgG1 did not mediate lysis against any of the tested target cell lines.

Example 15: Phase 3 Clinical Trial Assessing the Safety and Efficacy of mAb15160

After obtaining safety and tolerability data from healthy volunteers treated with mAb15160, a phase 3, randomized, double-blind, placebo-controlled study is initiated to assess the safety and efficacy of mAb15160 to prevent symptomatic COVID-19 (Table 37). This is an event-driven study that is anticipated to enroll approximately 5000 participants of age ≥18 years with and without risk factors for severe SARS-CoV-2 infection, who are PCR negative for SARS-CoV-2 at the time of randomization. Study participants are randomized in a 1:1 ratio into one of 2 treatment groups (300 mg mAb15160 administered once every 12 weeks (Q12W) or placebo) administered as subcutaneous (SC) injections over 6 months.

The primary endpoint of this study is symptomatic RT-qPCR confirmed SARS-CoV-2 infection. The secondary endpoints include the safety and tolerability of repeated SC injections of mAb15160. Safety assessments include, but are not limited to, collection of treatment emergent adverse events, vital signs, and safety laboratory tests. Blood is also drawn for drug concentration, immunogenicity, and serum neutralizing titer measurements. Administration of mAb15160 results in a reduction in the percentage of symptomatic SARS-CoV-2 infection as compared to the placebo group.

TABLE 37

Phase 3 study design

| | |
|---|---|
| Hypothesis: | Prophylaxis with mAb15160 prevents symptomatic SARS-CoV-2 infection. |
| Treatment Arms and Dose: | mAb15160 (300 mg SC Q12W x2 doses) |
| | Placebo SC |
| Key Design Elements | This is an event-driven, phase 3, randomized, double-blind, placebo-controlled study to assess the safety and efficacy of mAb15160 to prevent symptomatic COVID-19 |
| | This study enrolls approximately 5000 participants of age ≥18 years with and without risk factors for severe SARS-CoV-2 infection. Study participants will be randomized in a 1:1 ratio into one of 2 treatment groups (mAb15160, or placebo) administered as subcutaneous injections over 6 months. |

TABLE 37-continued

Phase 3 study design

| | |
|---|---|
| Hypothesis: | Prophylaxis with mAb15160 prevents symptomatic SARS-CoV-2 infection. |
| Duration: | 253 days |
| Population: | ≥18 years-old with a SARS-CoV-2 negative RT-qPCR with and without risk factors for severe COVID-19 |
| Number of subjects planned: | Approximately 5000 participants |
| Primary Endpoint: | Symptomatic RT-qPCR-confirmed SARS-CoV-2 infection cases during the 6-month efficacy assessment period |
| Secondary Endpoint: | Safety and tolerability of repeated SC injections of mAb15160<br>Serum concentration and Immunogenicity of mAb15160 |

Q12W = dosed once every 12 weeks

Example 16: Phase 3 Clinical Trial Assessing the Safety and Efficacy of mAb15160 in Pre-Exposure Prophylaxis This is a phase 3, randomized, double-blind, placebo-controlled study in adults and adolescents to assess the safety and efficacy of mAb15160 as pre-exposure prophylaxis to prevent COVID-19. This event-driven study enrolls approximately 5000 participants of age ≥12 years. Study participants is randomized in a 1:1 ratio into one of 2 treatment groups (mAb15160 or placebo) administered as subcutaneous injections over 6 months. The study consists of three periods: a 1 to 14-day screening period, a 6-month prophylaxis and efficacy assessment period (EAP), and a 3-month follow-up period (see Table 38). Administration of mAb15160 results in a reduction in the percentage of symptomatic SARS-CoV-2 infection as compared to the placebo group.

Screening/Baseline

After participants provide informed consent, they are assessed for study eligibility. The screening visit occurs up to 14 days prior to the randomization and baseline visit, and in some subjects the screening, randomization and baseline visit may occur on the same day. To be included in the study, participants have a negative SARS-CoV-2 test result, preferably from a reverse-transcriptase polymerase-chain-reaction (RT-PCR) assay from a sample collected within 72 hours of the baseline visit. Randomization will be stratified for assignment of treatment group by age group category (≥12 years to <18 years, ≥18 years to ≤65 years, >65 years), immunocompromised status (yes/no), and by prior vaccination (yes/no). Approximately 20% or more of participants enrolled will have a status of immunocompromised.

Treatment and Efficacy Assessment Period (EAP)

On day 1, after assessing available lab results, completing baseline assessments, sample collection, and randomization, all participants receive their first dose of study drug. Study drug is administered as a 2.5 ml subcutaneous (SC) injection in a blinded manner. Participants are randomized in a 1:1 ratio to one of the two treatment groups: mAb15160 (300 mg administered subcutaneously once every 8 weeks (SC Q8W) or placebo administered subcutaneously once every 8 weeks.

TABLE 38

Phase 3 study design

| | | |
|---|---|---|
| HYPOTHESIS | Prophylaxis with subcutaneous mAb15160 will prevent symptomatic SARS-CoV-2 infection.<br>Note: Symptomatic SARS-CoV-2 infection is determined by a positive SARS-CoV-2 RT-qPCR result during the Efficacy Assessment Period (EAP) with at least one symptom occurring within ±10 days of a positive RT-qPCR. The EAP is from baseline to 6 months. | |
| STUDY OBJECTIVES AND ENDPOINTS | Primary Objective:<br>To evaluate the efficacy of mAb15160, compared with placebo, in preventing symptomatic SARS-CoV-2 infection. | Primary Endpoint:<br>Cumulative incidence of symptomatic, RT-PCR-confirmed SARS-CoV-2 infection cases during the efficacy assessment period (EAP) |
| | Secondary Objectives:<br>To evaluate the safety and tolerability of repeated SC injections of mAb15160 in the study population<br>To assess concentrations of mAb15160 in serum over time<br>To assess the immunogenicity of mAb15160 | Secondary Endpoints:<br>Proportion of participants with treatment-emergent adverse events (TEAEs), during the EAP and follow-up period<br>Proportion of participants with TEAEs leading to study drug discontinuation during the EAP and follow-up period<br>Proportion of participants with treatment-emergent serious adverse events (SAEs) during the EAP and follow-up period |

TABLE 38-continued

Phase 3 study design

| | |
|---|---|
| | Proportion of participants with adverse events of special interest (AESIs) during the EAP<br>Concentrations of mAb15160 in serum over time<br>Incidence and titer of anti-drug antibodies (ADA), and incidence of neutralizing antibodies (NAb) to mAb15160 over time |
| Exploratory Objectives:<br>To evaluate additional indicators of mAb15160 clinical efficacy and disease prevention, compared to placebo<br>To assess humoral immune response to SARS-CoV-2 at baseline and after administration of mAb15160<br>To assess serum neutralization potential of mAb15160<br>To characterize viral variants by sequencing SARS-CoV-2 in participants who become infected post-baseline<br>To explore biomarkers predictive or indicative of safety and/or efficacy of mAb15160, COVID-19 vaccine response, SARS-CoV-2 infection and immune response, COVID-19 disease progression and clinical outcomes of mAb15160<br>To explore relationships between mAb15160 exposure and selected efficacy and safety endpoints and/or biomarkers | Exploratory Endpoints:<br>Cumulative incidence of symptomatic, RT-PCR-confirmed SARS-CoV-2 infection cases during the follow-up period<br>Cumulative incidence of RT-PCR-confirmed SARS-CoV-2 infection cases (regardless of symptoms) during the EAP<br>Cumulative incidence of symptomatic, RT-PCR-confirmed SARS-CoV-2 infection cases during the efficacy assessment period (EAP), in subgroups of those with one or more risk factors for severe COVID<br>Proportion of participants with ≥1 moderate COVID-19 symptom during the EAP and follow-up period<br>Proportion of participants with COVID-19-related hospitalization, emergency room visit, urgent care center visit or death during the EAP and follow-up period<br>Proportion of participants with COVID-19-related hospitalization or death during the EAP and follow-up period<br>Proportion of participants requiring supplemental oxygen due to COVID-19 during the EAP and follow-up period<br>Proportion of participants admitted to an intensive care unit (ICU) due to COVID-19 until the end of the follow-up period<br>Proportion of participants requiring mechanical ventilation due to COVID-19 until the end of the follow-up period<br>Absolute levels, change from baseline and percentage change from baseline in serum anti-SARS-CoV-2 antibodies such as anti-nucleocapsid protein IgG measured at baseline and after administration of mAb15160 over time<br>Absolute values of serum neutralizing inhibitory dilution 50% (ID50) titers at baseline and post-mAb15160 treatment against D614G and omicron variants<br>Change from baseline in ID50 after mAb15160 treatment against D614G and omicron variants |

TABLE 38-continued

| Phase 3 study design | | |
|---|---|---|
| PATIENT POPULATION | | |
| Number of Subjects | Approximately 5000 participants are enrolled in the study. | |
| Study Population | This study enrolls participants with or without risk factors for progression to severe COVID-19, and who are RT-PCR negative at study entry. | |
| Inclusion Criteria | 1. | Age ≥12 years of age at screening. |
| | Note: participants ≥12 and <18 years of age must be immunocompromised and will only be enrolled where permitted by local requirements. | |
| | 2. | Has a SARS-CoV-2-negative RT-PCR result from a sample collected ≤72 hours prior to randomization or using a local RT-PCR test and sample collection following assay standards. |
| | Notes: The result should be reviewed and confirmed negative prior to dosing. | |
| | Nasopharyngeal swab sample is highly preferred but other sample types (such as nasal, oropharyngeal [OP], or saliva) adhering to local standards are acceptable. | |
| | 3. | Is willing and able to: |
| | a. | Provide informed consent signed by study participant or legally acceptable representative |
| | b. | Comply with clinic visits and study-related procedures, including providing nasopharyngeal swab samples |
| | 4. | Is judged by the investigator to be in stable health (including those who have a chronic stable medical condition) based on medical history, physical examination, vital sign measurements, and laboratory measurements performed at screening and/or prior to administration of study drug |
| Exclusion Criteria | 1. | Has a life expectancy of less than 2 years |
| | 2. | Has symptoms consistent with COVID-19 (as determined by the investigator) |
| | 3. | Has a history of COVID-19 infection or has received a SARS-CoV-2 investigational, authorized, or approved vaccine within 90 days prior to randomization |
| | 4. | Planned use of any investigational, authorized, or approved vaccine for COVID-19 during the EAP |
| | 5. | Prior, current, or planned use of any of the following treatments: COVID-19 convalescent plasma, other monoclonal antibodies against SARS-CoV-2 (eg, bamlanivimab and etesevimab, tixagevimab and cilgavimab, sotrovimab), or any other COVID-19 treatment (authorized, approved, or investigational) |
| | | Note: prior use is defined as the past 30 days or within 5 half-lives of the treatment (whichever is longer) from screening |
| | 6. | Is planned to initiate intravenous immunoglobulin (IVIG) or subcutaneous immunoglobulin (SCIG) therapy |
| | 7. | Has known active symptomatic infection with influenza or other respiratory pathogen, confirmed by a diagnostic test |
| | 8. | Current hospitalization or was hospitalized (ie, >24 hours) for any reason within 30 days of the screening visit |
| | 9. | Has known allergy or hypersensitivity to components of the study drugs |
| | 10. | Is pregnant or is breastfeeding. |
| | 11. | Is a woman of childbearing potential (WOCBP)[1] who is unwilling to practice highly effective contraception prior to the initial dose/start of the first treatment, during the study, and for at least 6 months after the last dose. Highly effective contraceptive measures include: |
| | a. | Abstinence[2,3] |
| | b. | Stable use of combined (estrogen and progestogen containing) hormonal contraception (oral, intravaginal, transdermal) or progestogen-only hormonal contraception (oral, injectable, implantable) associated with inhibition of ovulation initiated 2 or more menstrual cycles prior to screening |
| | c. | Intrauterine device (IUD) or intrauterine hormone-releasing system (IUS) |
| | d. | Bilateral tubal ligation |
| | [1]WOCBP are defined as women who are fertile following menarche until becoming postmenopausal, unless permanently sterile. Permanent sterilization methods include hysterectomy, bilateral salpingectomy, and bilateral oophorectomy. A postmenopausal state is defined as no menses for 12 months without an alternative medical cause. A high follicle stimulating hormone (FSH) level in the postmenopausal range may be used to confirm a postmenopausal state in women not using hormonal contraception or hormonal replacement therapy. However, in the absence of 12 months of amenorrhea, a single FSH measurement is insufficient to determine the occurrence of a postmenopausal state. | |

TABLE 38-continued

Phase 3 study design

|  |  |
|---|---|
|  | The above definitions are according to the Clinical Trial Facilitation Group (CTFG) guidance. Pregnancy testing and contraception are not required for women with documented hysterectomy or tubal ligation.<br>²Sexual abstinence is considered a highly effective method only if defined as refraining from heterosexual intercourse during the entire period of risk associated with the study drugs. The reliability of sexual abstinence needs to be evaluated in relation to the duration of the clinical trial and the preferred and usual lifestyle of the patient. Periodic abstinence (calendar, symptothermal, post-ovulation methods), withdrawal (coitus interruptus), spermicides only, and lactational amenorrhea method (LAM) are not acceptable methods |
| 12. | Is in, or is planned to enter a quarantine center |
| 13. | Is a member of the clinical site study team or their immediate family member |

TABLE 39

Sequences Excluded from ST.26-Formatted Sequence Listing

| SEQ ID NO: | Sequence |
|---|---|
| 13 | gaggtcagt |
| 14 | EVS |
| 33 | gagggcaat |
| 34 | EGN |
| 67 | gagggcact |
| 68 | EGT |
| 85 | gaggacagt |
| 86 | EDS |
| 105 | gctgcatcc |
| 106 | AAS |
| 125 | ggtgcatcc |
| 126 | GAS |
| 163 | ggtaacagc |
| 164 | GNS |
| 183 | agtaatgat |
| 184 | SND |
| 203 | gacaatgat |
| 204 | DND |
| 241 | gatgcatcc |
| 242 | DAS |
| 261 | ggtgcaaca |
| 262 | GAT |
| 299 | agtgataat |
| 300 | SDN |
| 319 | gtcaataat |
| 320 | VNN |
| 391 | aaggcatct |
| 392 | KAS |
| 445 | gataaaaac |
| 446 | DKN |
| 464 | gaactcact |
| 465 | ELT |
| 484 | gatgtcact |
| 485 | DVT |
| 504 | gaggtcact |
| 505 | EVT |
| 524 | gagggcagt |
| 525 | EGS |
| 541 | gatgtcagt |
| 542 | DVS |
| 577 | gaaaataat |
| 578 | ENN |
| 633 | ttgggttct |
| 634 | LGS |
| 653 | ttgggatct |
| 705 | tctgcatcc |
| 706 | SAS |
| 775 | aaagacagt |
| 776 | KDS |
| 795 | ggtaacacc |
| 796 | GNT |
| 846 | aagatttct |

TABLE 39-continued

Sequences Excluded from ST.26-Formatted Sequence Listing

| SEQ ID NO: | Sequence |
|---|---|
| 847 | KIS |
| 915 | ggtcacacc |
| 916 | GHT |
| 932 | aggaataat |
| 933 | RNN |
| 968 | tgggcatct |
| 969 | WAS |
| 1000 | ggtgcatcc |
| 1001 | GAS |
| 1021 | gctgcatcc |
| 1022 | AAS |
| 1041 | gatgtcagt |
| 1042 | DVS |
| 1061 | ggtaacagc |
| 1062 | GNS |

All references cited herein are incorporated by reference to the same extent as if each individual publication, database entry (e.g., Genbank sequences or GeneID entries), patent application, or patent, was specifically and individually indicated to be incorporated by reference. This statement of incorporation by reference is intended by Applicants to relate to each and every individual publication, database entry (e.g., Genbank sequences or GeneID entries), patent application, or patent identified even if such citation is not immediately adjacent to a dedicated statement of incorporation by reference. The inclusion of dedicated statements of incorporation by reference, if any, within the specification does not in any way weaken this general statement of incorporation by reference. Citation of the references herein is not intended as an admission that the reference is pertinent prior art, nor does it constitute any admission as to the contents or date of these publications or documents.

SEQUENCE LISTING (1077 sequences)

SEQ ID NO: 1 - DNA, 375 bp, synthetic construct
  misc_feature 1..375: note = Synthetic
  source 1..375: mol_type = other DNA
gaggtgcagctggtggagactggaggaggcttgatccagcctggggagtccctgagactctcctgtgcagcctctgggttcatcgtcagtaccaactacatgaactgggtccgccaggctccagggaaggggctggagtgggtctcagttatttatagaggtggtagcacatactacgcagactccgtgaagggccgattcaccatctccagagacaactccaagaacacgctgtttcttcaaatgaacagcctgagagccgaggacacggccgtttattactgtgcgagaggccacgaagactttgactatgatactcctgcaagcggggcttttgatatctggggccaagggacaatggtcaccgtctcttca

SEQ ID NO: 2 - protein, 125 aa, synthetic construct
  REGION 1..125: note = Synthetic
EVQLVETGGGLIQPGESLRLSCAASGFIVSTNYMNWVRQAPGKGLEWVSVIYRGGSTYYADSVKGRFTISRDNSKNTLFLQMNSLRAEDTAVYYCARGHEDFDYDTPASGAFDIWGQGTMVTVSS

SEQ ID NO: 3 - DNA, 24 bp, synthetic construct
  misc_feature 1..24: note = Synthetic
  source 1..24: mol_type = other DNA
gggttcatcgtcagtaccaactac

SEQ ID NO: 4 - protein, 8 aa, synthetic construct
  REGION 1..8: note = Synthetic
GFIVSTNY

SEQ ID NO: 5 - DNA, 21 bp, synthetic construct
  misc_feature 1..21: note = Synthetic
  source 1..21: mol_type = other DNA
atttatagaggtggtagcaca

SEQ ID NO: 6 - protein, 7 aa, synthetic construct
  REGION 1..7: note = Synthetic
IYRGGST

SEQ ID NO: 7 - DNA, 57 bp, synthetic construct
  misc_feature 1..57: note = Synthetic
  source 1..57: mol_type = other DNA
gcgagaggccacgaagactttgactatgatactcctgcaagcggggcttttgatatc

SEQ ID NO: 8 - protein, 19 aa, synthetic construct
  REGION 1..19: note = Synthetic
ARGHEDFDYDTPASGAFDI

SEQ ID NO: 9 - DNA, 330 bp, synthetic construct
  misc_feature 1..330: note = Synthetic
  source 1..330: mol_type = other DNA
cagtctgccctgactcagcctccctccgcgtccgggtctcctggacagtcagtcaccatctcctgcactggaaccagcagtgacgttggtggtcataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaagtttgtcttcggaactgggaccaaggtcaccgtccta

SEQ ID NO: 10 - protein, 110 aa, synthetic construct
  REGION 1..110: note = Synthetic
QSALTQPPSASGSPGQSVTISCTGTSSDVGGHNYVSWYQQHPGKAPKVMIYEVSKRPSGVPDRFSGSKSGNTASLTVSGLQAEDEADYYCSSYAGSNKFVFGTGTKVTVL

SEQ ID NO: 11 - DNA, 27 bp, synthetic construct
  misc_feature 1..27: note = Synthetic
  source 1..27: mol_type = other DNA
agcagtgacgttggtggtcataactat

SEQ ID NO: 12 - protein, 9 aa, synthetic construct
  REGION 1..9: note = Synthetic
SSDVGGHNY

SEQ ID NO: 13-14 - skipped (2 entries)

SEQ ID NO: 15 - DNA, 30 bp, synthetic construct
  misc_feature 1..30: note = Synthetic
  source 1..30: mol_type = other DNA
agctcatatgcaggcagcaacaagtttgtc

SEQ ID NO: 16 - protein, 10 aa, synthetic construct
  REGION 1..10: note = Synthetic
SSYAGSNKFV

SEQ ID NO: 17 - DNA, 1368 bp, synthetic construct
  misc_feature 1..1368: note = Synthetic
  source 1..1368: mol_type = other DNA
gaggtgcagctggtggagactggaggaggcttgatccagcctggggagtccctgagactctcctgtgcagcctctgggttcatcgtcagtaccaactacatgaactgggtccgccaggctccagggaaggggctggagtgggtctcagttatttatagaggtggtagcacatactacgcagactccgtgaagggccgattcaccatctccagagacaactccaagaacacgctgtttcttcaaatgaacagcctgagagccgaggacacggccgtttattactgtgcgagaggccacgaagactttgactatgatactcctgcaagcggggcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 18 - protein, 455 aa, synthetic construct
  REGION 1..455: note = Synthetic
EVQLVETGGGLIQPGESLRLSCAASGFIVSTNYMNWVRQAPGKGLEWVSVIYRGGSTYYADSVKGRFTISRDNSKNTLFLQMNSLRAEDTAVYYCARGHEDFDYDTPASGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 19 - DNA, 651 bp, synthetic construct
  misc_feature 1..651: note = Synthetic
  source 1..651: mol_type = other DNA
cagtctgccctgactcagcctccctccgcgtccgggtctcctggacagtcagtcaccatctcctgcactggaaccagcagtgacgttggtggtcataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaagtttgtcttcggaactgggaccaaggtcaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 20 - protein, 216 aa, synthetic construct
  REGION 1..216: note = Synthetic
QSALTQPPSASGSPGQSVTISCTGTSSDVGGHNYVSWYQQHPGKAPKVMIYEVSKRPSGVPDRFSGSKSGNTASLTVSGLQAEDEADYYCSSYAGSNKFVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 21 - DNA, 369 bp, synthetic construct
  misc_feature 1..369: note = Synthetic
  source 1..369: mol_type = other DNA
gaggtgcagctggtggagtctggaggaggcttggtccagcctggggggtccctgagactctcctgtgcagcctctgggttcgccgtcagtagcaactacatgacctgggtccgccaggctccagggaaggggctggagtgggtcgcaactatttatagcggtgatagtacttactacgcagactccgtgaagggccgattcaccatctccagacacaattccaagaacacgctgtctcttcaaatgaacagcctgagagctgacgacacggccatttattactgtgcgagactgtcaggggtcttaagtgggacctacaacggcgcttttgatatctggggccaagggacaatggtcaccgtctcttca

SEQ ID NO: 22 - protein, 123 aa, synthetic construct
  REGION 1..123: note = Synthetic
EVQLVESGGGLVQPGGSLRLSCAASGFAVSSNYMTWVRQAPGKGLEWVATIYSGDSTYYADSVKGRFTISRHNSKNTLSLQMNSLRADDTAIYYCARLSGVLSGTYNGAFDIWGQGTMVTVSS

SEQ ID NO: 23 - DNA, 24 bp, synthetic construct
  misc_feature 1..24: note = Synthetic
  source 1..24: mol_type = other DNA
gggttcgccgtcagtagcaactac

SEQ ID NO: 24 - protein, 8 aa, synthetic construct
  REGION 1..8: note = Synthetic
GFAVSSNY

SEQ ID NO: 25 - DNA, 21 bp, synthetic construct
  misc_feature 1..21: note = Synthetic
  source 1..21: mol_type = other DNA
atttatagcggtgatagtact

SEQ ID NO: 26 - protein, 7 aa, synthetic construct
  REGION 1..7: note = Synthetic
IYSGDST

SEQ ID NO: 27 - DNA, 51 bp, synthetic construct
  misc_feature 1..51: note = Synthetic
  source 1..51: mol_type = other DNA
gcgagactgtcaggggtcttaagtgggacctacaacggcgcttttgatatc

SEQ ID NO: 28 - protein, 17 aa, synthetic construct
  REGION 1..17: note = Synthetic
ARLSGVLSGTYNGAFDI

SEQ ID NO: 29 - DNA, 330 bp, synthetic construct
  misc_feature 1..330: note = Synthetic
  source 1..330: mol_type = other DNA
cagtctgccctgactcagcctgcctccgtgtctgggtctcctggacagtcgatcaccatctcctgcactggaaccagcagtgattttgggaattataatattgtctcctggtatcaacaacacccaggccaagcccccaaagtcatgatttatgagggcaataagcggccctcaggggtttctaatcgcttctctggctccaagtctggccacacggcctccctgacaatctctgggcttcaggctgaggacgaggctgattattattgctcctcatatgcaggtagtagcacttgggtattcggcggagggaccaagctgaccgtccta

SEQ ID NO: 30 - protein, 110 aa, synthetic construct
  REGION 1..110: note = Synthetic
QSALTQPASVSGSPGQSITISCTGTSSDFGNYNIVSWYQQHPGQAPKVMIYEGNKRPSGVSNRFSGSKSGHTASLTISGLQAEDEADYYCSSYAGSSTWVFGGGTKLTVL

SEQ ID NO: 31 - DNA, 27 bp, synthetic construct
  misc_feature 1..27: note = Synthetic
  source 1..27: mol_type = other DNA
agcagtgattttgggaattataatatt

SEQ ID NO: 32 - protein, 9 aa, synthetic construct
  REGION 1..9: note = Synthetic
SSDFGNYNI

SEQ ID NO: 33-34 - skipped (2 entries)

SEQ ID NO: 35 - DNA, 30 bp, synthetic construct
  misc_feature 1..30: note = Synthetic
  source 1..30: mol_type = other DNA
tcctcatatgcaggtagtagcacttgggta

SEQ ID NO: 36 - protein, 10 aa, synthetic construct
  REGION 1..10: note = Synthetic
SSYAGSSTWV

SEQ ID NO: 37 - DNA, 1362 bp, synthetic construct
  misc_feature 1..1362: note = Synthetic
  source 1..1362: mol_type = other DNA
gaggtgcagctggtggagtctggaggaggcttggtccagcctggggggtccctgagactctcctgtgcagcctctgggttcgccgtcagtagcaactacatgacctgggtccgccaggctccagggaaggggctggagtgggtcgcaactatttatagcggtgatagtacttactacgcagactccgtgaagggccgattcaccatctccagacacaattccaagaacacgctgtctcttcaaatgaacagcctgagagctgacgacacggccatttattactgtgcgagactgtcaggggtcttaagtgggacctacaacggcgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 38 - protein, 453 aa, synthetic construct
  REGION 1..453: note = Synthetic
EVQLVESGGGLVQPGGSLRLSCAASGFAVSSNYMTWVRQAPGKGLEWVATIYSGDSTYYADSVKGRFTISRHNSKNTLSLQMNSLRADDTAIYYCARLSGVLSGTYNGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39 - DNA, 651 bp, synthetic construct
  misc_feature 1..651: note = Synthetic
  source 1..651: mol_type = other DNA
cagtctgccctgactcagcctgcctccgtgtctgggtctcctggacagtcgatcaccatctcctgcactggaaccagcagtgattttgggaattataatattgtctcctggtatcaacaacacccaggccaagcccccaaagtcatgatttatgagggcaataagcggccctcaggggtttctaatcgcttctctggctccaagtctggccacacggcctccctgacaatctctgggcttcaggctgaggacgaggctgattattattgctcctcatatgcaggtagtagcacttgggtattcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 40 - protein, 216 aa, synthetic construct
  REGION 1..216: note = Synthetic
QSALTQPASVSGSPGQSITISCTGTSSDFGNYNIVSWYQQHPGQAPKVMIYEGNKRPSGVSNRFSGSKSGHTASLTISGLQAEDEADYYCSSYAGSSTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 41 - DNA, 366 bp, synthetic construct
  misc_feature 1..366: note = Synthetic
  source 1..366: mol_type = other DNA
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagctatttatagcggcgatagcacatactacgcagactccgtgaagggcagattcaccatctccaaagacaattccaagaacacgctgtatcttcaaatgaacagcctgagaggcgaggacacggctgtttattactgtgcgagactcgggggggctctacaagcctatgatggggcctttgactactggggccagggaaccctggccaccgtctcctca

SEQ ID NO: 42 - protein, 122 aa, synthetic construct
  REGION 1..122: note = Synthetic
EVQLVESGGGLVQPGGSLRLSCAASGFTVSSNYMSWVRQAPGKGLEWVSAIYSGDSTYYADSVKGRFTISKDNSKNTLYLQMNSLRGEDTAVYYCARLGGALQAYDGAFDYWGQGTLATVSS

SEQ ID NO: 43 - DNA, 24 bp, synthetic construct
  misc_feature 1..24: note = Synthetic
  source 1..24: mol_type = other DNA
ggattcaccgtcagtagcaactac

SEQ ID NO: 44 - protein, 8 aa, synthetic construct
  REGION 1..8: note = Synthetic
GFTVSSNY

SEQ ID NO: 45 - DNA, 21 bp, synthetic construct
  misc_feature 1..21: note = Synthetic
  source 1..21: mol_type = other DNA
atttatagcggcgatagcaca

SEQ ID NO: 46 - DNA, 48 bp, synthetic construct
  misc_feature 1..48: note = Synthetic
  source 1..48: mol_type = other DNA
gcgagactcgggggggctctacaagcctatgatggggcctttgactac

SEQ ID NO: 47 - protein, 16 aa, synthetic construct
  REGION 1..16: note = Synthetic
ARLGGALQAYDGAFDY

SEQ ID NO: 48 - DNA, 330 bp, synthetic construct
  misc_feature 1..330: note = Synthetic
  source 1..330: mol_type = other DNA
cagtctgccctgactcagcctgcctccgtgtctgggtctcctggacagtcgatcaccatctcctgcactggaaccagcagtgattttgggagttataaccttgtctcctggtaccaacagcacccaggcaaagcccccaaactcatgatttatgagggcaataagcggccctcaggggtttctattcgcttctctggctccaagtctggcaacacggcctccctgacaatctctgggctccaggctgaggacgaggctgattattactgctcctcatatgcaggtagtagcacttgggtgttcggcggagggaccaagctgaccgtccta

SEQ ID NO: 49 - protein, 110 aa, synthetic construct
  REGION 1..110: note = Synthetic
QSALTQPASVSGSPGQSITISCTGTSSDFGSYNLVSWYQQHPGKAPKLMIYEGNKRPSGVSIRFSGSKSGNTASLTISGLQAEDEADYYCSSYAGSSTWVFGGGTKLTVL

SEQ ID NO: 50 - DNA, 27 bp, synthetic construct
  misc_feature 1..27: note = Synthetic
  source 1..27: mol_type = other DNA
agcagtgattttgggagttataacctt

SEQ ID NO: 51 - protein, 9 aa, synthetic construct
  REGION 1..9: note = Synthetic
SSDFGSYNL

SEQ ID NO: 52 - DNA, 30 bp, synthetic construct
  misc_feature 1..30: note = Synthetic
  source 1..30: mol_type = other DNA
tcctcatatgcaggtagtagcacttgggtg

SEQ ID NO: 53 - DNA, 1359 bp, synthetic construct
  misc_feature 1..1359: note = Synthetic
  source 1..1359: mol_type = other DNA
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagctatttatagcggcgatagcacatactacgcagactccgtgaagggcagattcaccatctccaaagacaattccaagaacacgctgtatcttcaaatgaacagcctgagaggcgaggacacggctgtttattactgtgcgagactcgggggggctctacaagcctatgatggggcctttgactactggggccagggaaccctggccaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 54 - protein, 452 aa, synthetic construct
  REGION 1..452: note = Synthetic
EVQLVESGGGLVQPGGSLRLSCAASGFTVSSNYMSWVRQAPGKGLEWVSAIYSGDSTYYADSVKGRFTISKDNSKNTLYLQMNSLRGEDTAVYYCARLGGALQAYDGAFDYWGQGTLATVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 55 - DNA, 651 bp, synthetic construct
  misc_feature 1..651: note = Synthetic
  source 1..651: mol_type = other DNA
cagtctgccctgactcagcctgcctccgtgtctgggtctcctggacagtcgatcaccatctcctgcactggaaccagcagtgattttgggagttataaccttgtctcctggtaccaacagcacccaggcaaagcccccaaactcatgatttatgagggcaataagcggccctcaggggtttctattcgcttctctggctccaagtctggcaacacggcctccctgacaatctctgggctccaggctgaggacgaggctgattattactgctcctcatatgcaggtagtagcacttgggtgttcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 56 - protein, 216 aa, synthetic construct
  REGION 1..216: note = Synthetic
QSALTQPASVSGSPGQSITISCTGTSSDFGSYNLVSWYQQHPGKAPKLMIYEGNKRPSGVSIRFSGSKSGNTASLTISGLQAEDEADYYCSSYAGSSTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 57 - DNA, 363 bp, synthetic construct
  misc_feature 1..363: note = Synthetic
  source 1..363: mol_type = other DNA
gaggtgcagctggtggagtctgggggaggcttggtccagcctggggggtccctgagactctcctgtgcagcctctggattcaccgtcactagcaactacatgagctgggtccgccaggctccagggaaggggctggagtgggtctcagcaatttatagcggtgaaagtacatactacgcagactccgtgaagggcagattcaccatctccagagacagttccaagaacacgctgtatcttcaaatgaacagcctgagagtcgaggacacggctgtgtattactgtgcgagtatacatgactacagtaactacgtcggggggttcgacccctggggccagggaaccctggtcaccgtctcctca

SEQ ID NO: 58 - protein, 121 aa, synthetic construct
  REGION 1..121: note = Synthetic
EVQLVESGGGLVQPGGSLRLSCAASGFTVTSNYMSWVRQAPGKGLEWVSAIYSGESTYYADSVKGRFTISRDSSKNTLYLQMNSLRVEDTAVYYCASIHDYSNYVGGFDPWGQGTLVTVSS

SEQ ID NO: 59 - DNA, 24 bp, synthetic construct
  misc_feature 1..24: note = Synthetic
  source 1..24: mol_type = other DNA
ggattcaccgtcactagcaactac

SEQ ID NO: 60 - protein, 8 aa, synthetic construct
  REGION 1..8: note = Synthetic
GFTVTSNY

SEQ ID NO: 61 - DNA, 21 bp, synthetic construct
  misc_feature 1..21: note = Synthetic
  source 1..21: mol_type = other DNA
atttatagcggtgaaagtaca

SEQ ID NO: 62 - protein, 7 aa, synthetic construct
  REGION 1..7: note = Synthetic
IYSGEST

SEQ ID NO: 63 - DNA, 45 bp, synthetic construct
  misc_feature 1..45: note = Synthetic
  source 1..45: mol_type = other DNA
gcgagtatacatgactacagtaactacgtcggggggttcgacccc

SEQ ID NO: 64 - protein, 15 aa, synthetic construct
  REGION 1..15: note = Synthetic
ASIHDYSNYVGGFDP

SEQ ID NO: 65 - DNA, 330 bp, synthetic construct
  misc_feature 1..330: note = Synthetic
  source 1..330: mol_type = other DNA
cagtctgccctgactcagcctgcctccgtgtctgggtctcctggacagtcgatcaccatctcctgcactggacccagcagtgattttgggagttataaccttgtctcctggtaccagcaacacccaggcaaagcccccaaactcatgatttatgagggcactaagcggccctcaggggtttctaatcgcttctctggctccaagtctggcaacacggcctccctgacaatctctgggctccaggctgaggacgaggctgactattactgctcctcatatgcaggtagtagcacttgggtgttcggcggagggaccaagctgaccgtccta

SEQ ID NO: 66 - protein, 110 aa, synthetic construct
  REGION 1..110: note = Synthetic
QSALTQPASVSGSPGQSITISCTGPSSDFGSYNLVSWYQQHPGKAPKLMIYEGTKRPSGVSNRFSGSKSGNTASLTISGLQAEDEADYYCSSYAGSSTWVFGGGTKLTVL

SEQ ID NO: 67-68 - skipped (2 entries)

SEQ ID NO: 69 - DNA, 1356 bp, synthetic construct
  misc_feature 1..1356: note = Synthetic
  source 1..1356: mol_type = other DNA
gaggtgcagctggtggagtctgggggaggcttggtccagcctggggggtccctgagactctcctgtgcagcctctggattcaccgtcactagcaactacatgagctgggtccgccaggctccagggaaggggctggagtgggtctcagcaatttatagcggtgaaagtacatactacgcagactccgtgaagggcagattcaccatctccagagacagttccaagaacacgctgtatcttcaaatgaacagcctgagagtcgaggacacggctgtgtattactgtgcgagtatacatgactacagtaactacgtcggggggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 70 - protein, 451 aa, synthetic construct
  REGION 1..451: note = Synthetic
EVQLVESGGGLVQPGGSLRLSCAASGFTVTSNYMSWVRQAPGKGLEWVSAIYSGESTYYADSVKGRFTISRDSSKNTLYLQMNSLRVEDTAVYYCASIHDYSNYVGGFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 71 - DNA, 651 bp, synthetic construct
  misc_feature 1..651: note = Synthetic
  source 1..651: mol_type = other DNA
cagtctgccctgactcagcctgcctccgtgtctgggtctcctggacagtcgatcaccatctcctgcactggacccagcagtgattttgggagttataaccttgtctcctggtaccagcaacacccaggcaaagcccccaaactcatgatttatgagggcactaagcggccctcaggggtttctaatcgcttctctggctccaagtctggcaacacggcctccctgacaatctctgggctccaggctgaggacgaggctgactattactgctcctcatatgcaggtagtagcacttgggtgttcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 72 - protein, 216 aa, synthetic construct
  REGION 1..216: note = Synthetic
QSALTQPASVSGSPGQSITISCTGPSSDFGSYNLVSWYQQHPGKAPKLMIYEGTKRPSGVSNRFSGSKSGNTASLTISGLQAEDEADYYCSSYAGSSTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 73 - DNA, 366 bp, synthetic construct
  misc_feature 1..366: note = Synthetic
  source 1..366: mol_type = other DNA
caggtgcagctgcaggagtcgggcccaggactggtgaagccttcggagaccctgtccctcacctgcactgtctctggtggctccatcagtggctactactggagctggatccggcagcccccagggaagggactggagtggattggctatatctattacagtgggagcaccaactacaacccctccctcaagagtcgagtcaccatgtcggtagacacgtccaagaaccagttctccctgaagctgagctctgtgaccgccgcagacacggccgtgtattactgtgcgagatacccgttatattctgaaagcagtggttatcattttgactactggggccacggaaccctggtcaccgtctcctca

SEQ ID NO: 74 - protein, 122 aa, synthetic construct
  REGION 1..122: note = Synthetic
QVQLQESGPGLVKPSETLSLTCTVSGGSISGYYWSWIRQPPGKGLEWIGYIYYSGSTNYNPSLKSRVTMSVDTSKNQFSLKLSSVTAADTAVYYCARYPLYSESSGYHFDYWGHGTLVTVSS

SEQ ID NO: 75 - DNA, 24 bp, synthetic construct
  misc_feature 1..24: note = Synthetic
  source 1..24: mol_type = other DNA
ggtggctccatcagtggctactac

SEQ ID NO: 76 - protein, 8 aa, synthetic construct
  REGION 1..8: note = Synthetic
GGSISGYY

SEQ ID NO: 77 - DNA, 21 bp, synthetic construct
  misc_feature 1..21: note = Synthetic
  source 1..21: mol_type = other DNA
atctattacagtgggagcacc

SEQ ID NO: 78 - protein, 7 aa, synthetic construct
  REGION 1..7: note = Synthetic
IYYSGST

SEQ ID NO: 79 - DNA, 48 bp, synthetic construct
  misc_feature 1..48: note = Synthetic
  source 1..48: mol_type = other DNA
gcgagatacccgttatattctgaaagcagtggttatcattttgactac

SEQ ID NO: 80 - protein, 16 aa, synthetic construct
  REGION 1..16: note = Synthetic
ARYPLYSESSGYHFDY

SEQ ID NO: 81 - DNA, 330 bp, synthetic construct
  misc_feature 1..330: note = Synthetic
  source 1..330: mol_type = other DNA
cagtctgccctgactcagcctgcctccgtgtctgggtctcctggacagtcgatcaccatctcctgcactggaaccagcagtgatgttgggagttataaccttgtctcctggtaccaacaggacccaggcaaagcccccaaactcatgctttatgaggacagtaagcggccctcaggggtttcgaatcgcttctctggctccaagtctggcaacacggcctccctgacaatctctgggctccaggctgaggacgaggctgattattactgctcctcatatgcaggtagaagcacttgggtgttcggcggagggaccaagctgaccgtccta

SEQ ID NO: 82 - protein, 110 aa, synthetic construct
  REGION 1..110: note = Synthetic
QSALTQPASVSGSPGQSITISCTGTSSDVGSYNLVSWYQQDPGKAPKLMLYEDSKRPSGVSNRFSGSKSGNTASLTISGLQAEDEADYYCSSYAGRSTWVFGGGTKLTVL

SEQ ID NO: 83 - DNA, 27 bp, synthetic construct
  misc_feature 1..27: note = Synthetic
  source 1..27: mol_type = other DNA
agcagtgatgttgggagttataacctt

SEQ ID NO: 84 - protein, 9 aa, synthetic construct
  REGION 1..9: note = Synthetic
SSDVGSYNL

SEQ ID NO: 85-86 - skipped (2 entries)

SEQ ID NO: 87 - DNA, 30 bp, synthetic construct
  misc_feature 1..30: note = Synthetic
  source 1..30: mol_type = other DNA
tcctcatatgcaggtagaagcacttgggtg

SEQ ID NO: 88 - protein, 10 aa, synthetic construct
  REGION 1..10: note = Synthetic
SSYAGRSTWV

SEQ ID NO: 89 - DNA, 1359 bp, synthetic construct
  misc_feature 1..1359: note = Synthetic
  source 1..1359: mol_type = other DNA
caggtgcagctgcaggagtcgggcccaggactggtgaagccttcggagaccctgtccctcacctgcactgtctctggtggctccatcagtggctactactggagctggatccggcagcccccagggaagggactggagtggattggctatatctattacagtgggagcaccaactacaacccctccctcaagagtcgagtcaccatgtcggtagacacgtccaagaaccagttctccctgaagctgagctctgtgaccgccgcagacacggccgtgtattactgtgcgagatacccgttatattctgaaagcagtggttatcattttgactactggggccacggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 90 - protein, 452 aa, synthetic construct
  REGION 1..452: note = Synthetic
QVQLQESGPGLVKPSETLSLTCTVSGGSISGYYWSWIRQPPGKGLEWIGYIYYSGSTNYNPSLKSRVTMSVDTSKNQFSLKLSSVTAADTAVYYCARYPLYSESSGYHFDYWGHGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 91 - DNA, 651 bp, synthetic construct
  misc_feature 1..651: note = Synthetic
  source 1..651: mol_type = other DNA
cagtctgccctgactcagcctgcctccgtgtctgggtctcctggacagtcgatcaccatctcctgcactggaaccagcagtgatgttgggagttataaccttgtctcctggtaccaacaggacccaggcaaagcccccaaactcatgctttatgaggacagtaagcggccctcaggggtttcgaatcgcttctctggctccaagtctggcaacacggcctccctgacaatctctgggctccaggctgaggacgaggctgattattactgctcctcatatgcaggtagaagcacttgggtgttcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 92 - protein, 216 aa, synthetic construct
  REGION 1..216: note = Synthetic
QSALTQPASVSGSPGQSITISCTGTSSDVGSYNLVSWYQQDPGKAPKLMLYEDSKRPSGVSNRFSGSKSGNTASLTISGLQAEDEADYYCSSYAGRSTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 93 - DNA, 351 bp, synthetic construct
  misc_feature 1..351: note = Synthetic
  source 1..351: mol_type = other DNA
gaggtgcagctggtggagtctggaggaggcttggtccagcctggggggtccctgagactctcctgtgcagccactgggatcaccgtcagtagcaactacatgagctgggtccgccaggccccaggaaaggggctggagtgggtctcgcttatttatagcggtggcagcacattctacgcagactccgtgaagggccgattcaccatctccagacacaattccaagaacacactatatcttcaaatgagcagcctgagagctgaggacacggccgtgtattactgtgcgagagacttagtggacttcggtatggacgtctggggccaagggaccacggtcaccgtctcctca

SEQ ID NO: 94 - protein, 117 aa, synthetic construct
  REGION 1..117: note = Synthetic
EVQLVESGGGLVQPGGSLRLSCAATGITVSSNYMSWVRQAPGKGLEWVSLIYSGGSTFYADSVKGRFTISRHNSKNTLYLQMSSLRAEDTAVYYCARDLVDFGMDVWGQGTTVTVSS

SEQ ID NO: 95 - DNA, 24 bp, synthetic construct
  misc_feature 1..24: note = Synthetic
  source 1..24: mol_type = other DNA
gggatcaccgtcagtagcaactac

SEQ ID NO: 96 - protein, 8 aa, synthetic construct
  REGION 1..8: note = Synthetic
GITVSSNY

SEQ ID NO: 97 - DNA, 21 bp, synthetic construct
  misc_feature 1..21: note = Synthetic
  source 1..21: mol_type = other DNA
atttatagcggtggcagcaca

SEQ ID NO: 98 - protein, 7 aa, synthetic construct
  REGION 1..7: note = Synthetic
IYSGGST

SEQ ID NO: 99 - DNA, 33 bp, synthetic construct
  misc_feature 1..33: note = Synthetic
  source 1..33: mol_type = other DNA
gcgagagacttagtggacttcggtatggacgtc

SEQ ID NO: 100 - protein, 11 aa, synthetic construct
  REGION 1..11: note = Synthetic
ARDLVDFGMDV

SEQ ID NO: 101 - DNA, 321 bp, synthetic construct
  misc_feature 1..321: note = Synthetic
  source 1..321: mol_type = other DNA
gacatccagttgacccagtctccatcctccctgtctgcatctgtaggagacagagtcaccatcacttgccgggccagtcagggcattagtaattatttagcctggtatcagcaaaaaccagggaaagcccctaagctcctgatctatgctgcatccactttgcaaagtggggtcccatcaaggttcagcggcagtggatctgggacagatttcactctcaccatcagcagcctgcagcctgaagattttggaacttattactgtcaacagcttaatagtgattctccgacgttcggccaagggaccaaggtggaaatcaaa

SEQ ID NO: 102 - protein, 107 aa, synthetic construct
  REGION 1..107: note = Synthetic
DIQLTQSPSSLSASVGDRVTITCRASQGISNYLAWYQQKPGKAPKLLIYAASTLQSGVPSRFSGSGSGTDFTLTISSLQPEDFGTYYCQQLNSDSPTFGQGTKVEIK

SEQ ID NO: 103 - DNA, 18 bp, synthetic construct
  misc_feature 1..18: note = Synthetic
  source 1..18: mol_type = other DNA
cagggcattagtaattat

SEQ ID NO: 104 - protein, 6 aa, synthetic construct
  REGION 1..6: note = Synthetic
QGISNY

SEQ ID NO: 105-106 - skipped (2 entries)

SEQ ID NO: 107 - DNA, 27 bp, synthetic construct
  misc_feature 1..27: note = Synthetic
  source 1..27: mol_type = other DNA
caacagcttaatagtgattctccgacg

SEQ ID NO: 108 - protein, 9 aa, synthetic construct
  REGION 1..9: note = Synthetic
QQLNSDSPT

SEQ ID NO: 109 - DNA, 1344 bp, synthetic construct
  misc_feature 1..1344: note = Synthetic
  source 1..1344: mol_type = other DNA
gaggtgcagctggtggagtctggaggaggcttggtccagcctggggggtccctgagactctcctgtgcagccactgggatcaccgtcagtagcaactacatgagctgggtccgccaggccccaggaaaggggctggagtgggtctcgcttatttatagcggtggcagcacattctacgcagactccgtgaagggccgattcaccatctccagacacaattccaagaacacactatatcttcaaatgagcagcctgagagctgaggacacggccgtgtattactgtgcgagagacttagtggacttcggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 110 - protein, 447 aa, synthetic construct
  REGION 1..447: note = Synthetic
EVQLVESGGGLVQPGGSLRLSCAATGITVSSNYMSWVRQAPGKGLEWVSLIYSGGSTFYADSVKGRFTISRHNSKNTLYLQMSSLRAEDTAVYYCARDLVDFGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 111 - DNA, 645 bp, synthetic construct
  misc_feature 1..645: note = Synthetic
  source 1..645: mol_type = other DNA
gacatccagttgacccagtctccatcctccctgtctgcatctgtaggagacagagtcaccatcacttgccgggccagtcagggcattagtaattatttagcctggtatcagcaaaaaccagggaaagcccctaagctcctgatctatgctgcatccactttgcaaagtggggtcccatcaaggttcagcggcagtggatctgggacagatttcactctcaccatcagcagcctgcagcctgaagattttggaacttattactgtcaacagcttaatagtgattctccgacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 112 - protein, 214 aa, synthetic construct
  REGION 1..214: note = Synthetic
DIQLTQSPSSLSASVGDRVTITCRASQGISNYLAWYQQKPGKAPKLLIYAASTLQSGVPSRFSGSGSGTDFTLTISSLQPEDFGTYYCQQLNSDSPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 113 - DNA, 384 bp, synthetic construct
  misc_feature 1..384: note = Synthetic
  source 1..384: mol_type = other DNA
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgacactaataccagatacagcccgtccttccaaggccaggtcaccatctcagccgacaagtccatcagcaccgcctacctgcagtggagcagcctgaaggcctcggacaccgccatgtattactgtgcgagacttcgagcaccatctggtccctgggagggagcaattccagggggcggtatggacgtctggggccaagggaccacggtcaccgtctcctca

SEQ ID NO: 114 - protein, 128 aa, synthetic construct
  REGION 1..128: note = Synthetic
EVQLVQSGAEVKKPGESLKISCKGSGYSFTSYWIGWVRQMPGKGLEWMGIIYPGDTNTRYSPSFQGQVTISADKSISTAYLQWSSLKASDTAMYYCARLRAPSGPWEGAIPGGGMDVWGQGTTVTVSS

SEQ ID NO: 115 - DNA, 24 bp, synthetic construct
  misc_feature 1..24: note = Synthetic
  source 1..24: mol_type = other DNA
ggatacagctttaccagctactgg

SEQ ID NO: 116 - protein, 8 aa, synthetic construct
  REGION 1..8: note = Synthetic
GYSFTSYW

SEQ ID NO: 117 - DNA, 24 bp, synthetic construct
  misc_feature 1..24: note = Synthetic
  source 1..24: mol_type = other DNA
atctatcctggtgacactaatacc

SEQ ID NO: 118 - protein, 8 aa, synthetic construct
  REGION 1..8: note = Synthetic
IYPGDTNT

SEQ ID NO: 119 - DNA, 63 bp, synthetic construct
  misc_feature 1..63: note = Synthetic
  source 1..63: mol_type = other DNA
gcgagacttcgagcaccatctggtccctgggagggagcaattccagggggcggtatggacgtc

SEQ ID NO: 120 - protein, 21 aa, synthetic construct
  REGION 1..21: note = Synthetic
ARLRAPSGPWEGAIPGGGMDV

SEQ ID NO: 121 - DNA, 324 bp, synthetic construct
  misc_feature 1..324: note = Synthetic
  source 1..324: mol_type = other DNA
gaaatagtgatgacgcagtctccagccaccctgtctgtgtctccaggggaaagagccaccctctcctgcagggccagtcagagtgttagcagcaacttagcctggtaccagcagaaacatggccaggctcccaggctcctcatctatggtgcatccaccagggccactggtatcccagccaggttcagtggcagtgggtctgggacagagttcactctcaccatcagcagtctgcagtctgaagattttgcagtttattactgtcagcagtataataactggcccccattcactttcggccctgggaccaaagtggatatcaaa

SEQ ID NO: 122 - protein, 108 aa, synthetic construct
  REGION 1..108: note = Synthetic
EIVMTQSPATLSVSPGERATLSCRASQSVSSNLAWYQQKHGQAPRLLIYGASTRATGIPARFSGSGSGTEFTLTISSLQSEDFAVYYCQQYNNWPPFTFGPGTKVDIK

SEQ ID NO: 123 - DNA, 18 bp, synthetic construct
  misc_feature 1..18: note = Synthetic
  source 1..18: mol_type = other DNA
cagagtgttagcagcaac

SEQ ID NO: 124 - protein, 6 aa, synthetic construct
  REGION 1..6: note = Synthetic
QSVSSN

SEQ ID NO: 125-126 - skipped (2 entries)

SEQ ID NO: 127 - DNA, 30 bp, synthetic construct
  misc_feature 1..30: note = Synthetic
  source 1..30: mol_type = other DNA
cagcagtataataactggcccccattcact

SEQ ID NO: 128 - protein, 10 aa, synthetic construct
  REGION 1..10: note = Synthetic
QQYNNWPPFT

SEQ ID NO: 129 - DNA, 1377 bp, synthetic construct
  misc_feature 1..1377: note = Synthetic
  source 1..1377: mol_type = other DNA
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgacactaataccagatacagcccgtccttccaaggccaggtcaccatctcagccgacaagtccatcagcaccgcctacctgcagtggagcagcctgaaggcctcggacaccgccatgtattactgtgcgagacttcgagcaccatctggtccctgggagggagcaattccagggggcggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 130 - protein, 458 aa, synthetic construct
  REGION 1..458: note = Synthetic
EVQLVQSGAEVKKPGESLKISCKGSGYSFTSYWIGWVRQMPGKGLEWMGIIYPGDTNTRYSPSFQGQVTISADKSISTAYLQWSSLKASDTAMYYCARLRAPSGPWEGAIPGGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 131 - DNA, 648 bp, synthetic construct
  misc_feature 1..648: note = Synthetic
  source 1..648: mol_type = other DNA
gaaatagtgatgacgcagtctccagccaccctgtctgtgtctccaggggaaagagccaccctctcctgcagggccagtcagagtgttagcagcaacttagcctggtaccagcagaaacatggccaggctcccaggctcctcatctatggtgcatccaccagggccactggtatcccagccaggttcagtggcagtgggtctgggacagagttcactctcaccatcagcagtctgcagtctgaagattttgcagtttattactgtcagcagtataataactggcccccattcactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 132 - protein, 215 aa, synthetic construct
  REGION 1..215: note = Synthetic
EIVMTQSPATLSVSPGERATLSCRASQSVSSNLAWYQQKHGQAPRLLIYGASTRATGIPARFSGSGSGTEFTLTISSLQSEDFAVYYCQQYNNWPPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 133 - DNA, 381 bp, synthetic construct
  misc_feature 1..381: note = Synthetic
  source 1..381: mol_type = other DNA
caggtgcagctggtgcagtctggggctgaggtgaagaagcctggggcctcagtgaaggtctcctgcaaggcttctggatacaccttcaccgactactatatgcactgggtgcgacaggcccctggacaagggcttgagtggatgggatggatcaaccctaacagtggtggcacgaactatgcacagaagtttcagggcagggtcaccatgaccagggacacgtccatcagcacagcgtacatggagctgagcaggctgagatctgacgacacggccatttattactgtgcgaggactcttttcaagtattacgatattttgattggttatggtgaatacttccagcactggggccagggcaccctggtcatcgtctcctca

SEQ ID NO: 134 - protein, 127 aa, synthetic construct
  REGION 1..127: note = Synthetic
QVQLVQSGAEVKKPGASVKVSCKASGYTFTDYYMHWVRQAPGQGLEWMGWINPNSGGTNYAQKFQGRVTMTRDTSISTAYMELSRLRSDDTAIYYCARTLFKYYDILIGYGEYFQHWGQGTLVIVSS

SEQ ID NO: 135 - DNA, 24 bp, synthetic construct
  misc_feature 1..24: note = Synthetic
  source 1..24: mol_type = other DNA
ggatacaccttcaccgactactat

SEQ ID NO: 136 - protein, 8 aa, synthetic construct
  REGION 1..8: note = Synthetic
GYTFTDYY

SEQ ID NO: 137 - DNA, 24 bp, synthetic construct
  misc_feature 1..24: note = Synthetic
  source 1..24: mol_type = other DNA
atcaaccctaacagtggtggcacg

SEQ ID NO: 138 - protein, 8 aa, synthetic construct
  REGION 1..8: note = Synthetic
INPNSGGT

SEQ ID NO: 139 - DNA, 60 bp, synthetic construct
  misc_feature 1..60: note = Synthetic
  source 1..60: mol_type = other DNA
gcgaggactcttttcaagtattacgatattttgattggttatggtgaatacttccagcac

SEQ ID NO: 140 - protein, 20 aa, synthetic construct
  REGION 1..20: note = Synthetic
ARTLFKYYDILIGYGEYFQH

SEQ ID NO: 141 - DNA, 324 bp, synthetic construct
  misc_feature 1..324: note = Synthetic
  source 1..324: mol_type = other DNA
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactgccatcccagacaggttcagtggtagtgggtctgggacagacttcactctcaccatcagcagactggagcctgaagattttgcagtgtatttctgtcagcagtatggtagctcaccctggacgttcggccaagggaccaaggtggagatcaaa

SEQ ID NO: 142 - protein, 108 aa, synthetic construct
  REGION 1..108: note = Synthetic
EIVLTQSPGTLSLSPGERATLSCRASQSVSSSYLAWYQQKPGQAPRLLIYGASSRATAIPDRFSGSGSGTDFTLTISRLEPEDFAVYFCQQYGSSPWTFGQGTKVEIK

SEQ ID NO: 143 - DNA, 21 bp, synthetic construct
  misc_feature 1..21: note = Synthetic
  source 1..21: mol_type = other DNA
cagagtgttagcagcagctac

SEQ ID NO: 144 - protein, 7 aa, synthetic construct
  REGION 1..7: note = Synthetic
QSVSSSY

SEQ ID NO: 145 - DNA, 27 bp, synthetic construct
  misc_feature 1..27: note = Synthetic
  source 1..27: mol_type = other DNA
cagcagtatggtagctcaccctggacg

SEQ ID NO: 146 - protein, 9 aa, synthetic construct
  REGION 1..9: note = Synthetic
QQYGSSPWT

SEQ ID NO: 147 - DNA, 1374 bp, synthetic construct
  misc_feature 1..1374: note = Synthetic
  source 1..1374: mol_type = other DNA
caggtgcagctggtgcagtctggggctgaggtgaagaagcctggggcctcagtgaaggtctcctgcaaggcttctggatacaccttcaccgactactatatgcactgggtgcgacaggcccctggacaagggcttgagtggatgggatggatcaaccctaacagtggtggcacgaactatgcacagaagtttcagggcagggtcaccatgaccagggacacgtccatcagcacagcgtacatggagctgagcaggctgagatctgacgacacggccatttattactgtgcgaggactcttttcaagtattacgatattttgattggttatggtgaatacttccagcactggggccagggcaccctggtcatcgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 148 - protein, 457 aa, synthetic construct
  REGION 1..457: note = Synthetic
QVQLVQSGAEVKKPGASVKVSCKASGYTFTDYYMHWVRQAPGQGLEWMGWINPNSGGTNYAQKFQGRVTMTRDTSISTAYMELSRLRSDDTAIYYCARTLFKYYDILIGYGEYFQHWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 149 - DNA, 648 bp, synthetic construct
  misc_feature 1..648: note = Synthetic
  source 1..648: mol_type = other DNA
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactgccatcccagacaggttcagtggtagtgggtctgggacagacttcactctcaccatcagcagactggagcctgaagattttgcagtgtatttctgtcagcagtatggtagctcaccctggacgttcggccaagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 150 - protein, 215 aa, synthetic construct
  REGION 1..215: note = Synthetic
EIVLTQSPGTLSLSPGERATLSCRASQSVSSSYLAWYQQKPGQAPRLLIYGASSRATAIPDRFSGSGSGTDFTLTISRLEPEDFAVYFCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 151 - DNA, 360 bp, synthetic construct
  misc_feature 1..360: note = Synthetic
  source 1..360: mol_type = other DNA
gaggtgcagctggtggagtctggaggaggcttggtccagccgggggggtccctgagactctcctgtgcagcctctgggttcaccgtcagtaggagctatatgacctgggtccgccaggctccagggaaggggctggagtgggtctcagttatttttaccggtggtagaacagaccacgcagactccgtgaagggccgattcaccatctccagacacaattccaagaatacgctgtatcttcaaatgaatagcctgagaactgaggacacggccgtgtattactgtgcgagagtcgctatagtgggagctacaggggcttttgatatctggggccaagggacaatggtcaccgtctcttca

SEQ ID NO: 152 - protein, 120 aa, synthetic construct
  REGION 1..120: note = Synthetic
EVQLVESGGGLVQPGGSLRLSCAASGFTVSRSYMTWVRQAPGKGLEWVSVIFTGGRTDHADSVKGRFTISRHNSKNTLYLQMNSLRTEDTAVYYCARVAIVGATGAFDIWGQGTMVTVSS

SEQ ID NO: 153 - DNA, 24 bp, synthetic construct
  misc_feature 1..24: note = Synthetic
  source 1..24: mol_type = other DNA
gggttcaccgtcagtaggagctat

SEQ ID NO: 154 - protein, 8 aa, synthetic construct
  REGION 1..8: note = Synthetic
GFTVSRSY

SEQ ID NO: 155 - DNA, 21 bp, synthetic construct
  misc_feature 1..21: note = Synthetic
  source 1..21: mol_type = other DNA
atttttaccggtggtagaaca

SEQ ID NO: 156 - protein, 7 aa, synthetic construct
  REGION 1..7: note = Synthetic
IFTGGRT

SEQ ID NO: 157 - DNA, 42 bp, synthetic construct
  misc_feature 1..42: note = Synthetic
  source 1..42: mol_type = other DNA
gcgagagtcgctatagtgggagctacaggggcttttgatatc

SEQ ID NO: 158 - protein, 14 aa, synthetic construct
  REGION 1..14: note = Synthetic
ARVAIVGATGAFDI

SEQ ID NO: 159 - DNA, 336 bp, synthetic construct
  misc_feature 1..336: note = Synthetic
  source 1..336: mol_type = other DNA
cagtctgtgctgacgcagccgccctcagtgtctggggccccagggcagagggtcaccatctcctgcactgggagcagctccaatatcggggcaggtgatgatgtacactggtaccagcaacttccaggaacagcccccaaactcctcatctacggtaacagcaatcggccctcaggggtccctgaccgattctctggctccaagtctggcacctcagcctccctggccatcactgggctccaggctgaggatgaggctgattattactgccagtcctatgacagcagcctgagtggttctgtggtattcggcggagggaccaagctgaccgtccta

SEQ ID NO: 160 - protein, 112 aa, synthetic construct
  REGION 1..112: note = Synthetic
QSVLTQPPSVSGAPGQRVTISCTGSSSNIGAGDDVHWYQQLPGTAPKLLIYGNSNRPSGVPDRFSGSKSGTSASLAITGLQAEDEADYYCQSYDSSLSGSVVFGGGTKLTVL

SEQ ID NO: 161 - DNA, 27 bp, synthetic construct
  misc_feature 1..27: note = Synthetic
  source 1..27: mol_type = other DNA
agctccaatatcggggcaggtgatgat

SEQ ID NO: 162 - protein, 9 aa, synthetic construct
  REGION 1..9: note = Synthetic
SSNIGAGDD

SEQ ID NO: 163-164 - skipped (2 entries)

SEQ ID NO: 165 - DNA, 36 bp, synthetic construct
  misc_feature 1..36: note = Synthetic
  source 1..36: mol_type = other DNA
cagtcctatgacagcagcctgagtggttctgtggta

SEQ ID NO: 166 - protein, 12 aa, synthetic construct
  REGION 1..12: note = Synthetic
QSYDSSLSGSVV

SEQ ID NO: 167 - DNA, 1353 bp, synthetic construct
  misc_feature 1..1353: note = Synthetic
  source 1..1353: mol_type = other DNA
gaggtgcagctggtggagtctggaggaggcttggtccagccgggggggtccctgagactctcctgtgcagcctctgggttcaccgtcagtaggagctatatgacctgggtccgccaggctccagggaaggggctggagtgggtctcagttatttttaccggtggtagaacagaccacgcagactccgtgaagggccgattcaccatctccagacacaattccaagaatacgctgtatcttcaaatgaatagcctgagaactgaggacacggccgtgtattactgtgcgagagtcgctatagtgggagctacaggggcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 168 - protein, 450 aa, synthetic construct
  REGION 1..450: note = Synthetic
EVQLVESGGGLVQPGGSLRLSCAASGFTVSRSYMTWVRQAPGKGLEWVSVIFTGGRTDHADSVKGRFTISRHNSKNTLYLQMNSLRTEDTAVYYCARVAIVGATGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 169 - DNA, 657 bp, synthetic construct
  misc_feature 1..657: note = Synthetic
  source 1..657: mol_type = other DNA
cagtctgtgctgacgcagccgccctcagtgtctggggccccagggcagagggtcaccatctcctgcactgggagcagctccaatatcggggcaggtgatgatgtacactggtaccagcaacttccaggaacagcccccaaactcctcatctacggtaacagcaatcggccctcaggggtccctgaccgattctctggctccaagtctggcacctcagcctccctggccatcactgggctccaggctgaggatgaggctgattattactgccagtcctatgacagcagcctgagtggttctgtggtattcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 170 - protein, 218 aa, synthetic construct
  REGION 1..218: note = Synthetic
QSVLTQPPSVSGAPGQRVTISCTGSSSNIGAGDDVHWYQQLPGTAPKLLIYGNSNRPSGVPDRFSGSKSGTSASLAITGLQAEDEADYYCQSYDSSLSGSVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 171 - DNA, 369 bp, synthetic construct
  misc_feature 1..369: note = Synthetic
  source 1..369: mol_type = other DNA
gaagtgcagctggtggagtctgggggaggcttggtacagcctggcaggtccctgagactctcctgtgtagcctctggattcacctttgatgattctgccatgcactgggtccggcaacctccagggaagggcctggagtgggtctcaggtattagttggaatagtggtatcataggctatgcggagtctgtgaagggccgattcatcatctccagagacaacgccaagaactccctctttctgcacatgagaggtctgagacctgaagacacggccgtgtattactgtgcaagagataggctggaactttcctactattattatggtatggacgtctggggccaagggaccacggtcaccgtctcctca

SEQ ID NO: 172 - protein, 123 aa, synthetic construct
  REGION 1..123: note = Synthetic
EVQLVESGGGLVQPGRSLRLSCVASGFTFDDSAMHWVRQPPGKGLEWVSGISWNSGIIGYAESVKGRFIISRDNAKNSLFLHMRGLRPEDTAVYYCARDRLELSYYYYGMDVWGQGTTVTVSS

SEQ ID NO: 173 - DNA, 24 bp, synthetic construct
  misc_feature 1..24: note = Synthetic
  source 1..24: mol_type = other DNA
ggattcacctttgatgattctgcc

SEQ ID NO: 174 - protein, 8 aa, synthetic construct
  REGION 1..8: note = Synthetic
GFTFDDSA

SEQ ID NO: 175 - DNA, 24 bp, synthetic construct
  misc_feature 1..24: note = Synthetic
  source 1..24: mol_type = other DNA
attagttggaatagtggtatcata

SEQ ID NO: 176 - protein, 8 aa, synthetic construct
  REGION 1..8: note = Synthetic
ISWNSGII

SEQ ID NO: 177 - DNA, 48 bp, synthetic construct
  misc_feature 1..48: note = Synthetic
  source 1..48: mol_type = other DNA
gcaagagataggctggaactttcctactattattatggtatggacgtc

SEQ ID NO: 178 - protein, 16 aa, synthetic construct
  REGION 1..16: note = Synthetic
ARDRLELSYYYYGMDV

SEQ ID NO: 179 - DNA, 330 bp, synthetic construct
  misc_feature 1..330: note = Synthetic
  source 1..330: mol_type = other DNA
cagtctgtgctgactcagccaccctcagcgtctgggacccccgggcagagggtcaccatctcttgttctggaagcagctccaacatcggaagtaatactgtaaactggtaccagcagttcccaggaacggcccccagactcctcatctatagtaatgatcagcggccctcagggatccctgaccgattctctggctccaagtctggcacctcagcctccctggccatcagtgggctccagtctgaggatgaggctgattattactgttcaacatgggatgacagcctgaatggtgctgtgttcggaggaggcacccagctgaccgtcctc

SEQ ID NO: 180 - protein, 110 aa, synthetic construct
  REGION 1..110: note = Synthetic
QSVLTQPPSASGTPGQRVTISCSGSSSNIGSNTVNWYQQFPGTAPRLLIYSNDQRPSGIPDRFSGSKSGTSASLAISGLQSEDEADYYCSTWDDSLNGAVFGGGTQLTVL

SEQ ID NO: 181 - DNA, 24 bp, synthetic construct
  misc_feature 1..24: note = Synthetic
  source 1..24: mol_type = other DNA
agctccaacatcggaagtaatact

SEQ ID NO: 182 - protein, 8 aa, synthetic construct
  REGION 1..8: note = Synthetic
SSNIGSNT

SEQ ID NO: 183-184 - skipped (2 entries)

SEQ ID NO: 185 - DNA, 33 bp, synthetic construct
  misc_feature 1..33: note = Synthetic
  source 1..33: mol_type = other DNA
tcaacatgggatgacagcctgaatggtgctgtg

SEQ ID NO: 186 - protein, 11 aa, synthetic construct
  REGION 1..11: note = Synthetic
STWDDSLNGAV

SEQ ID NO: 187 - DNA, 1362 bp, synthetic construct
  misc_feature 1..1362: note = Synthetic
  source 1..1362: mol_type = other DNA
gaagtgcagctggtggagtctgggggaggcttggtacagcctggcaggtccctgagactctcctgtgtagcctctggattcacctttgatgattctgccatgcactgggtccggcaacctccagggaagggcctggagtgggtctcaggtattagttggaatagtggtatcataggctatgcggagtctgtgaagggccgattcatcatctccagagacaacgccaagaactccctctttctgcacatgagaggtctgagacctgaagacacggccgtgtattactgtgcaagagataggctggaactttcctactattattatggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 188 - protein, 453 aa, synthetic construct
  REGION 1..453: note = Synthetic
EVQLVESGGGLVQPGRSLRLSCVASGFTFDDSAMHWVRQPPGKGLEWVSGISWNSGIIGYAESVKGRFIISRDNAKNSLFLHMRGLRPEDTAVYYCARDRLELSYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 189 - DNA, 651 bp, synthetic construct
  misc_feature 1..651: note = Synthetic
  source 1..651: mol_type = other DNA
cagtctgtgctgactcagccaccctcagcgtctgggacccccgggcagagggtcaccatctcttgttctggaagcagctccaacatcggaagtaatactgtaaactggtaccagcagttcccaggaacggcccccagactcctcatctatagtaatgatcagcggccctcagggatccctgaccgattctctggctccaagtctggcacctcagcctccctggccatcagtgggctccagtctgaggatgaggctgattattactgttcaacatgggatgacagcctgaatggtgctgtgttcggaggaggcacccagctgaccgtcctcggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 190 - protein, 216 aa, synthetic construct
  REGION 1..216: note = Synthetic
QSVLTQPPSASGTPGQRVTISCSGSSSNIGSNTVNWYQQFPGTAPRLLIYSNDQRPSGIPDRFSGSKSGTSASLAISGLQSEDEADYYCSTWDDSLNGAVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 191 - DNA, 363 bp, synthetic construct
  misc_feature 1..363: note = Synthetic
  source 1..363: mol_type = other DNA
cgggtcaccttgagggagtctggtcctgcgctggtgaaacccacacagaccctcacactgacctgcaccttctctgggttctcactctacagtagtggaatgtccgtgagctggatccgtcagcccccagggaaggccctggagtggcttgcacgcattgattgggatgatgatgaatactacagttcttttctgaagaccaggctcaccatctccaaggacatctccaaaaaccaggtggtccttacaatgaccaacctggaccctgtggacacagccacgtattactgtgtacggcctcgatattccagtaattttggttttgagtactggggccagggaaccctggtcaccgtctcctca

SEQ ID NO: 192 - protein, 121 aa, synthetic construct
  REGION 1..121: note = Synthetic
RVTLRESGPALVKPTQTLTLTCTFSGFSLYSSGMSVSWIRQPPGKALEWLARIDWDDDEYYSSFLKTRLTISKDISKNQVVLTMTNLDPVDTATYYCVRPRYSSNFGFEYWGQGTLVTVSS

SEQ ID NO: 193 - DNA, 30 bp, synthetic construct
  misc_feature 1..30: note = Synthetic
  source 1..30: mol_type = other DNA
gggttctcactctacagtagtggaatgtcc

SEQ ID NO: 194 - protein, 10 aa, synthetic construct
  REGION 1..10: note = Synthetic
GFSLYSSGMS

SEQ ID NO: 195 - DNA, 21 bp, synthetic construct
  misc_feature 1..21: note = Synthetic
  source 1..21: mol_type = other DNA
attgattgggatgatgatgaa

SEQ ID NO: 196 - protein, 7 aa, synthetic construct
  REGION 1..7: note = Synthetic
IDWDDDE

SEQ ID NO: 197 - DNA, 39 bp, synthetic construct
  misc_feature 1..39: note = Synthetic
  source 1..39: mol_type = other DNA
gtacggcctcgatattccagtaattttggttttgagtac

SEQ ID NO: 198 - protein, 13 aa, synthetic construct
  REGION 1..13: note = Synthetic
VRPRYSSNFGFEY

SEQ ID NO: 199 - DNA, 330 bp, synthetic construct
  misc_feature 1..330: note = Synthetic
  source 1..330: mol_type = other DNA
cagtctgtgttgacgcagccgccctcagtgtctgcggccccaggacagaaggtcaccatctcctgctctggatccatctccaacattgggaataattatgtatcctggtaccaacaactcccaggaacagcccccaaactcctcatttatgacaatgataagcgaccctcagggattcctgaccgattctctggctccaggtctggcacgtcagccaccctgggcatcaccggactccagactggggacgaggccgattattactgcggaacatgggatagcagcctgactgcttatgtcttcggaactgggaccaaggtcaccgtccta

SEQ ID NO: 200 - protein, 110 aa, synthetic construct
  REGION 1..110: note = Synthetic
QSVLTQPPSVSAAPGQKVTISCSGSISNIGNNYVSWYQQLPGTAPKLLIYDNDKRPSGIPDRFSGSRSGTSATLGITGLQTGDEADYYCGTWDSSLTAYVFGTGTKVTVL

SEQ ID NO: 201 - DNA, 24 bp, synthetic construct
  misc_feature 1..24: note = Synthetic
  source 1..24: mol_type = other DNA
atctccaacattgggaataattat

SEQ ID NO: 202 - protein, 8 aa, synthetic construct
  REGION 1..8: note = Synthetic
ISNIGNNY

SEQ ID NO: 203-204 - skipped (2 entries)

SEQ ID NO: 205 - DNA, 33 bp, synthetic construct
  misc_feature 1..33: note = Synthetic
  source 1..33: mol_type = other DNA
ggaacatgggatagcagcctgactgcttatgtc

SEQ ID NO: 206 - protein, 11 aa, synthetic construct
  REGION 1..11: note = Synthetic
GTWDSSLTAYV

SEQ ID NO: 207 - DNA, 1356 bp, synthetic construct
  misc_feature 1..1356: note = Synthetic
  source 1..1356: mol_type = other DNA
cgggtcaccttgagggagtctggtcctgcgctggtgaaacccacacagaccctcacactgacctgcaccttctctgggttctcactctacagtagtggaatgtccgtgagctggatccgtcagcccccagggaaggccctggagtggcttgcacgcattgattgggatgatgatgaatactacagttcttttctgaagaccaggctcaccatctccaaggacatctccaaaaaccaggtggtccttacaatgaccaacctggaccctgtggacacagccacgtattactgtgtacggcctcgatattccagtaattttggttttgagtactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 208 - protein, 451 aa, synthetic construct
  REGION 1..451: note = Synthetic
RVTLRESGPALVKPTQTLTLTCTFSGFSLYSSGMSVSWIRQPPGKALEWLARIDWDDDEYYSSFLKTRLTISKDISKNQVVLTMTNLDPVDTATYYCVRPRYSSNFGFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 209 - DNA, 651 bp, synthetic construct
  misc_feature 1..651: note = Synthetic
  source 1..651: mol_type = other DNA
cagtctgtgttgacgcagccgccctcagtgtctgcggccccaggacagaaggtcaccatctcctgctctggatccatctccaacattgggaataattatgtatcctggtaccaacaactcccaggaacagcccccaaactcctcatttatgacaatgataagcgaccctcagggattcctgaccgattctctggctccaggtctggcacgtcagccaccctgggcatcaccggactccagactggggacgaggccgattattactgcggaacatgggatagcagcctgactgcttatgtcttcggaactgggaccaaggtcaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 210 - protein, 216 aa, synthetic construct
  REGION 1..216: note = Synthetic
QSVLTQPPSVSAAPGQKVTISCSGSISNIGNNYVSWYQQLPGTAPKLLIYDNDKRPSGIPDRFSGSRSGTSATLGITGLQTGDEADYYCGTWDSSLTAYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 211 - DNA, 363 bp, synthetic construct
  misc_feature 1..363: note = Synthetic
  source 1..363: mol_type = other DNA
caggtgcagctggtgcagtctggggctgaggtgaagaagcctgggtcctcggtgaaggtctcctgcaaggcttctggagacaccttcagcacctatgctatcaactgggtgcgacaggcccctggacaagggcttgagtggatgggaagattcatccatatctttggtacagcaaactacgcacagaagttccagggcagagtcaccattaccgcggacgaatccacgagcacagcctacatggagctgcgcagcctgagatctgaggacacggccgtttattactgcgcgagagacggagtagactacggtgactaccgacctgactactggggccagggaaccctggtcaccgtctcctca

SEQ ID NO: 212 - protein, 121 aa, synthetic construct
  REGION 1..121: note = Synthetic
QVQLVQSGAEVKKPGSSVKVSCKASGDTFSTYAINWVRQAPGQGLEWMGRFIHIFGTANYAQKFQGRVTITADESTSTAYMELRSLRSEDTAVYYCARDGVDYGDYRPDYWGQGTLVTVSS

SEQ ID NO: 213 - DNA, 24 bp, synthetic construct
  misc_feature 1..24: note = Synthetic
  source 1..24: mol_type = other DNA
ggagacaccttcagcacctatgct

SEQ ID NO: 214 - protein, 8 aa, synthetic construct
  REGION 1..8: note = Synthetic
GDTFSTYA

SEQ ID NO: 215 - DNA, 24 bp, synthetic construct
  misc_feature 1..24: note = Synthetic
  source 1..24: mol_type = other DNA
ttcatccatatctttggtacagca

SEQ ID NO: 216 - protein, 8 aa, synthetic construct
  REGION 1..8: note = Synthetic
FIHIFGTA

SEQ ID NO: 217 - DNA, 42 bp, synthetic construct
  misc_feature 1..42: note = Synthetic
  source 1..42: mol_type = other DNA
gcgagagacggagtagactacggtgactaccgacctgactac

SEQ ID NO: 218 - protein, 14 aa, synthetic construct
  REGION 1..14: note = Synthetic
ARDGVDYGDYRPDY

SEQ ID NO: 219 - DNA, 324 bp, synthetic construct
  misc_feature 1..324: note = Synthetic
  source 1..324: mol_type = other DNA
gaaattgtgttgacgcagtctccaggcaccctgtctttgtctccaggggaaagagccaccctctcctgcagggccagtcagagtgttagtagcaactacttagcctggtaccagcagaaacctggccaggctcccagactcctcatctatggtgcatccagcagggccactggcatcccagagaggttcagtggcagtgggtctgggacagacttcactctcaccatcagcagactggagcctgaagattttgcagtatattactgtcagcagtatggtagctcgctgtacacttttggccaggggaccaagctggagatcaaa

SEQ ID NO: 220 - protein, 108 aa, synthetic construct
  REGION 1..108: note = Synthetic
EIVLTQSPGTLSLSPGERATLSCRASQSVSSNYLAWYQQKPGQAPRLLIYGASSRATGIPERFSGSGSGTDFTLTISRLEPEDFAVYYCQQYGSSLYTFGQGTKLEIK

SEQ ID NO: 221 - DNA, 21 bp, synthetic construct
  misc_feature 1..21: note = Synthetic
  source 1..21: mol_type = other DNA
cagagtgttagtagcaactac

SEQ ID NO: 222 - protein, 7 aa, synthetic construct
  REGION 1..7: note = Synthetic
QSVSSNY

SEQ ID NO: 223 - DNA, 27 bp, synthetic construct
  misc_feature 1..27: note = Synthetic
  source 1..27: mol_type = other DNA
cagcagtatggtagctcgctgtacact

SEQ ID NO: 224 - protein, 9 aa, synthetic construct
  REGION 1..9: note = Synthetic
QQYGSSLYT

SEQ ID NO: 225 - DNA, 1356 bp, synthetic construct
  misc_feature 1..1356: note = Synthetic
  source 1..1356: mol_type = other DNA
caggtgcagctggtgcagtctggggctgaggtgaagaagcctgggtcctcggtgaaggtctcctgcaaggcttctggagacaccttcagcacctatgctatcaactgggtgcgacaggcccctggacaagggcttgagtggatgggaagattcatccatatctttggtacagcaaactacgcacagaagttccagggcagagtcaccattaccgcggacgaatccacgagcacagcctacatggagctgcgcagcctgagatctgaggacacggccgtttattactgcgcgagagacggagtagactacggtgactaccgacctgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 226 - protein, 451 aa, synthetic construct
  REGION 1..451: note = Synthetic
QVQLVQSGAEVKKPGSSVKVSCKASGDTFSTYAINWVRQAPGQGLEWMGRFIHIFGTANYAQKFQGRVTITADESTSTAYMELRSLRSEDTAVYYCARDGVDYGDYRPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 227 - DNA, 648 bp, synthetic construct
  misc_feature 1..648: note = Synthetic
  source 1..648: mol_type = other DNA
gaaattgtgttgacgcagtctccaggcaccctgtctttgtctccaggggaaagagccaccctctcctgcagggccagtcagagtgttagtagcaactacttagcctggtaccagcagaaacctggccaggctcccagactcctcatctatggtgcatccagcagggccactggcatcccagagaggttcagtggcagtgggtctgggacagacttcactctcaccatcagcagactggagcctgaagattttgcagtatattactgtcagcagtatggtagctcgctgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 228 - protein, 215 aa, synthetic construct
  REGION 1..215: note = Synthetic
EIVLTQSPGTLSLSPGERATLSCRASQSVSSNYLAWYQQKPGQAPRLLIYGASSRATGIPERFSGSGSGTDFTLTISRLEPEDFAVYYCQQYGSSLYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 229 - DNA, 357 bp, synthetic construct
  misc_feature 1..357: note = Synthetic
  source 1..357: mol_type = other DNA
caggtgcagctggtgcagtctggggctgaggtgaagaagcctgggtcctcggtgaaggtctcctgcaaggctcctggaggcaccttcagcacctatgctatcaactgggtgcgacaggcccctggacaagggcttgagtggatgggaaggatcgtccctttctttggtacaacaaactacgcacagaagttccagggcagagtcacgattaccgcggacgaatccacgagcacagcctacatggagctgagcagcctgacatctgaggacacggccgtatattactgtgcgagaggtccgagaccgttcggggaattattatactggggccagggaaccctggtcaccgtctcctca

SEQ ID NO: 230 - protein, 119 aa, synthetic construct
  REGION 1..119: note = Synthetic
QVQLVQSGAEVKKPGSSVKVSCKAPGGTFSTYAINWVRQAPGQGLEWMGRIVPFFGTTNYAQKFQGRVTITADESTSTAYMELSSLTSEDTAVYYCARGPRPFGELLYWGQGTLVTVSS

SEQ ID NO: 231 - DNA, 24 bp, synthetic construct
  misc_feature 1..24: note = Synthetic
  source 1..24: mol_type = other DNA
ggaggcaccttcagcacctatgct

SEQ ID NO: 232 - protein, 8 aa, synthetic construct
  REGION 1..8: note = Synthetic
GGTFSTYA

SEQ ID NO: 233 - DNA, 24 bp, synthetic construct
  misc_feature 1..24: note = Synthetic
  source 1..24: mol_type = other DNA
atcgtccctttctttggtacaaca

SEQ ID NO: 234 - protein, 8 aa, synthetic construct
  REGION 1..8: note = Synthetic
IVPFFGTT

SEQ ID NO: 235 - DNA, 36 bp, synthetic construct
  misc_feature 1..36: note = Synthetic
  source 1..36: mol_type = other DNA
gcgagaggtccgagaccgttcggggaattattatac

SEQ ID NO: 236 - protein, 12 aa, synthetic construct
  REGION 1..12: note = Synthetic
ARGPRPFGELLY

SEQ ID NO: 237 - DNA, 321 bp, synthetic construct
  misc_feature 1..321: note = Synthetic
  source 1..321: mol_type = other DNA
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcaggctgaagatattgcaacatattactgtcaacaatatgataatctcctattcactttcggccctgggaccaaagtggatatcaaa

SEQ ID NO: 238 - protein, 107 aa, synthetic construct
  REGION 1..107: note = Synthetic
DIQMTQSPSSLSASVGDRVTITCQASQDISNYLNWYQQKPGKAPKLLIYDASNLETGVPSRFSGSGSGTDFTFTISSLQAEDIATYYCQQYDNLLFTFGPGTKVDIK

SEQ ID NO: 239 - DNA, 18 bp, synthetic construct
  misc_feature 1..18: note = Synthetic
  source 1..18: mol_type = other DNA
caggacattagcaactat

SEQ ID NO: 240 - protein, 6 aa, synthetic construct
  REGION 1..6: note = Synthetic
QDISNY

SEQ ID NO: 241-242 - skipped (2 entries)

SEQ ID NO: 243 - DNA, 27 bp, synthetic construct
  misc_feature 1..27: note = Synthetic
  source 1..27: mol_type = other DNA
caacaatatgataatctcctattcact

SEQ ID NO: 244 - protein, 9 aa, synthetic construct
  REGION 1..9: note = Synthetic
QQYDNLLFT

SEQ ID NO: 245 - DNA, 1350 bp, synthetic construct
  misc_feature 1..1350: note = Synthetic
  source 1..1350: mol_type = other DNA
caggtgcagctggtgcagtctggggctgaggtgaagaagcctgggtcctcggtgaaggtctcctgcaaggctcctggaggcaccttcagcacctatgctatcaactgggtgcgacaggcccctggacaagggcttgagtggatgggaaggatcgtccctttctttggtacaacaaactacgcacagaagttccagggcagagtcacgattaccgcggacgaatccacgagcacagcctacatggagctgagcagcctgacatctgaggacacggccgtatattactgtgcgagaggtccgagaccgttcggggaattattatactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 246 - protein, 449 aa, synthetic construct
  REGION 1..449: note = Synthetic
QVQLVQSGAEVKKPGSSVKVSCKAPGGTFSTYAINWVRQAPGQGLEWMGRIVPFFGTTNYAQKFQGRVTITADESTSTAYMELSSLTSEDTAVYYCARGPRPFGELLYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 247 - DNA, 645 bp, synthetic construct
  misc_feature 1..645: note = Synthetic
  source 1..645: mol_type = other DNA
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcaggctgaagatattgcaacatattactgtcaacaatatgataatctcctattcactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 248 - protein, 214 aa, synthetic construct
  REGION 1..214: note = Synthetic
DIQMTQSPSSLSASVGDRVTITCQASQDISNYLNWYQQKPGKAPKLLIYDASNLETGVPSRFSGSGSGTDFTFTISSLQAEDIATYYCQQYDNLLFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 249 - DNA, 357 bp, synthetic construct
  misc_feature 1..357: note = Synthetic
  source 1..357: mol_type = other DNA
gaggtgcagctggtggagactggaggaggcttgatccagcctggggggtccctgagactctcctgtgcagcgcctgggttcatcgtcagtagcaactacatgagctgggtccgccaggctccagggaaggggctggagtgggtctcacttctttatcccggtggtagcacatactacgcagactccgtgaagggccgattcaccatctccagagacaattccaagaacacgctgtatcttcaaatgaacagcctgagagccgacgacacggccgtgtattactgtgcgagagtcctccctatagtagaggaccactttgactactggggccagggaaccctggtcaccgtctcctca

SEQ ID NO: 250 - protein, 119 aa, synthetic construct
  REGION 1..119: note = Synthetic
EVQLVETGGGLIQPGGSLRLSCAAPGFIVSSNYMSWVRQAPGKGLEWVSLLYPGGSTYYADSVKGRFTISRDNSKNTLYLQMNSLRADDTAVYYCARVLPIVEDHFDYWGQGTLVTVSS

SEQ ID NO: 251 - DNA, 24 bp, synthetic construct
  misc_feature 1..24: note = Synthetic
  source 1..24: mol_type = other DNA
gggttcatcgtcagtagcaactac

SEQ ID NO: 252 - protein, 8 aa, synthetic construct
  REGION 1..8: note = Synthetic
GFIVSSNY

SEQ ID NO: 253 - DNA, 21 bp, synthetic construct
  misc_feature 1..21: note = Synthetic
  source 1..21: mol_type = other DNA
ctttatcccggtggtagcaca

SEQ ID NO: 254 - protein, 7 aa, synthetic construct
  REGION 1..7: note = Synthetic
LYPGGST

SEQ ID NO: 255 - DNA, 39 bp, synthetic construct
  misc_feature 1..39: note = Synthetic
  source 1..39: mol_type = other DNA
gcgagagtcctccctatagtagaggaccactttgactac

SEQ ID NO: 256 - protein, 13 aa, synthetic construct
  REGION 1..13: note = Synthetic
ARVLPIVEDHFDY

SEQ ID NO: 257 - DNA, 330 bp, synthetic construct
  misc_feature 1..330: note = Synthetic
  source 1..330: mol_type = other DNA
gacatccagttgacccagtctccatccttcctgtctgcatctgtaggagacagagtcaccatcacttgccgggccagtcagggcatgagcagttatttagcctggtatcagaaaaaaccagggaaagcccctaagctcctgatctatggtgcaacaattctgcaaagtggggtcccatcaaggttcagcggcagtggatctgggacagaattcactctcacaatcagcagcctgcagcctgaagattttgcaacttattactgtcaacagcttaatagtgaccccctatacatgtacacttttggccaggggaccaagctggagatcaaa

SEQ ID NO: 258 - protein, 110 aa, synthetic construct
  REGION 1..110: note = Synthetic
DIQLTQSPSFLSASVGDRVTITCRASQGMSSYLAWYQKKPGKAPKLLIYGATILQSGVPSRFSGSGSGTEFTLTISSLQPEDFATYYCQQLNSDPLYMYTFGQGTKLEIK

SEQ ID NO: 259 - DNA, 18 bp, synthetic construct
  misc_feature 1..18: note = Synthetic
  source 1..18: mol_type = other DNA
cagggcatgagcagttat

SEQ ID NO: 260 - protein, 6 aa, synthetic construct
  REGION 1..6: note = Synthetic
QGMSSY

SEQ ID NO: 261-262 - skipped (2 entries)

SEQ ID NO: 263 - DNA, 36 bp, synthetic construct
  misc_feature 1..36: note = Synthetic
  source 1..36: mol_type = other DNA
caacagcttaatagtgaccccctatacatgtacact

SEQ ID NO: 264 - protein, 12 aa, synthetic construct
  REGION 1..12: note = Synthetic
QQLNSDPLYMYT

SEQ ID NO: 265 - DNA, 1350 bp, synthetic construct
  misc_feature 1..1350: note = Synthetic
  source 1..1350: mol_type = other DNA
gaggtgcagctggtggagactggaggaggcttgatccagcctggggggtccctgagactctcctgtgcagcgcctgggttcatcgtcagtagcaactacatgagctgggtccgccaggctccagggaaggggctggagtgggtctcacttctttatcccggtggtagcacatactacgcagactccgtgaagggccgattcaccatctccagagacaattccaagaacacgctgtatcttcaaatgaacagcctgagagccgacgacacggccgtgtattactgtgcgagagtcctccctatagtagaggaccactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 266 - protein, 449 aa, synthetic construct
  REGION 1..449: note = Synthetic
EVQLVETGGGLIQPGGSLRLSCAAPGFIVSSNYMSWVRQAPGKGLEWVSLLYPGGSTYYADSVKGRFTISRDNSKNTLYLQMNSLRADDTAVYYCARVLPIVEDHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 267 - DNA, 654 bp, synthetic construct
  misc_feature 1..654: note = Synthetic
  source 1..654: mol_type = other DNA
gacatccagttgacccagtctccatccttcctgtctgcatctgtaggagacagagtcaccatcacttgccgggccagtcagggcatgagcagttatttagcctggtatcagaaaaaaccagggaaagcccctaagctcctgatctatggtgcaacaattctgcaaagtggggtcccatcaaggttcagcggcagtggatctgggacagaattcactctcacaatcagcagcctgcagcctgaagattttgcaacttattactgtcaacagcttaatagtgaccccctatacatgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 268 - protein, 217 aa, synthetic construct
  REGION 1..217: note = Synthetic
DIQLTQSPSFLSASVGDRVTITCRASQGMSSYLAWYQKKPGKAPKLLIYGATILQSGVPSRFSGSGSGTEFTLTISSLQPEDFATYYCQQLNSDPLYMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 269 - DNA, 366 bp, synthetic construct
  misc_feature 1..366: note = Synthetic
  source 1..366: mol_type = other DNA
caggtgcagctggtggagtctgggggaggcgtggtccagcctgggaggtccctgagactctcctgtgcagcgtctggtttcgtcttcaatagctatggcatgcactgggtccgccaggctccaggcaaggggctggagtgggtggcagttctatggtatgaaggaagtaaaaattactatgcagactccgtgaagggccgattcaccatctccagagacaattccaagaacacactgtatctgcaaatgaacagcctgagagccgaggacacggctgtgtattactgtgcgaggcatggttcagggagtttttttgggtactacttggactactggggccagggaaccctggtcaccgtctcctca

SEQ ID NO: 270 - protein, 122 aa, synthetic construct
  REGION 1..122: note = Synthetic
QVQLVESGGGVVQPGRSLRLSCAASGFVFNSYGMHWVRQAPGKGLEWVAVLWYEGSKNYYADSVKGRFTISRDNSKNTLYLQMNSLRAEDTAVYYCARHGSGSFFGYYLDYWGQGTLVTVSS

SEQ ID NO: 271 - DNA, 24 bp, synthetic construct
  misc_feature 1..24: note = Synthetic
  source 1..24: mol_type = other DNA
ggtttcgtcttcaatagctatggc

SEQ ID NO: 272 - protein, 8 aa, synthetic construct
  REGION 1..8: note = Synthetic
GFVFNSYG

SEQ ID NO: 273 - DNA, 24 bp, synthetic construct
  misc_feature 1..24: note = Synthetic
  source 1..24: mol_type = other DNA
ctatggtatgaaggaagtaaaaat

SEQ ID NO: 274 - protein, 8 aa, synthetic construct
  REGION 1..8: note = Synthetic
LWYEGSKN

SEQ ID NO: 275 - DNA, 45 bp, synthetic construct
  misc_feature 1..45: note = Synthetic
  source 1..45: mol_type = other DNA
gcgaggcatggttcagggagtttttttgggtactacttggactac

SEQ ID NO: 276 - protein, 15 aa, synthetic construct
  REGION 1..15: note = Synthetic
ARHGSGSFFGYYLDY

SEQ ID NO: 277 - DNA, 321 bp, synthetic construct
  misc_feature 1..321: note = Synthetic
  source 1..321: mol_type = other DNA
gacatccagatgacccagtctccatcctccctgtctgcatctgtaggagacagagtcaccatcacttgccgggcaagtcacaacattaatgactttttaaattggtatcagcagaaaccagggaaagcccctaggctcctgatctatgctgcatccagtttgcaaagtggggtcccatcaaggttcagtggcagtggatctgggacagatttcactctcaccatcagcagtctacaacctgaagattttgcaacttactactgtcaagagagttacactacccctccgacttttggccaggggaccaagctggagatcaaa

SEQ ID NO: 278 - protein, 107 aa, synthetic construct
  REGION 1..107: note = Synthetic
DIQMTQSPSSLSASVGDRVTITCRASHNINDFLNWYQQKPGKAPRLLIYAASSLQSGVPSRFSGSGSGTDFTLTISSLQPEDFATYYCQESYTTPPTFGQGTKLEIK

SEQ ID NO: 279 - DNA, 18 bp, synthetic construct
  misc_feature 1..18: note = Synthetic
  source 1..18: mol_type = other DNA
cacaacattaatgacttt

SEQ ID NO: 280 - protein, 6 aa, synthetic construct
  REGION 1..6: note = Synthetic
HNINDF

SEQ ID NO: 281 - DNA, 27 bp, synthetic construct
  misc_feature 1..27: note = Synthetic
  source 1..27: mol_type = other DNA
caagagagttacactacccctccgact

SEQ ID NO: 282 - protein, 9 aa, synthetic construct
  REGION 1..9: note = Synthetic
QESYTTPPT

SEQ ID NO: 283 - DNA, 1359 bp, synthetic construct
  misc_feature 1..1359: note = Synthetic
  source 1..1359: mol_type = other DNA
caggtgcagctggtggagtctgggggaggcgtggtccagcctgggaggtccctgagactctcctgtgcagcgtctggtttcgtcttcaatagctatggcatgcactgggtccgccaggctccaggcaaggggctggagtgggtggcagttctatggtatgaaggaagtaaaaattactatgcagactccgtgaagggccgattcaccatctccagagacaattccaagaacacactgtatctgcaaatgaacagcctgagagccgaggacacggctgtgtattactgtgcgaggcatggttcagggagtttttttgggtactacttggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 284 - protein, 452 aa, synthetic construct
  REGION 1..452: note = Synthetic
QVQLVESGGGVVQPGRSLRLSCAASGFVFNSYGMHWVRQAPGKGLEWVAVLWYEGSKNYYADSVKGRFTISRDNSKNTLYLQMNSLRAEDTAVYYCARHGSGSFFGYYLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 285 - DNA, 645 bp, synthetic construct
  misc_feature 1..645: note = Synthetic
  source 1..645: mol_type = other DNA
gacatccagatgacccagtctccatcctccctgtctgcatctgtaggagacagagtcaccatcacttgccgggcaagtcacaacattaatgactttttaaattggtatcagcagaaaccagggaaagcccctaggctcctgatctatgctgcatccagtttgcaaagtggggtcccatcaaggttcagtggcagtggatctgggacagatttcactctcaccatcagcagtctacaacctgaagattttgcaacttactactgtcaagagagttacactacccctccgacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 286 - protein, 214 aa, synthetic construct
  REGION 1..214: note = Synthetic
DIQMTQSPSSLSASVGDRVTITCRASHNINDFLNWYQQKPGKAPRLLIYAASSLQSGVPSRFSGSGSGTDFTLTISSLQPEDFATYYCQESYTTPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 287 - DNA, 366 bp, synthetic construct
  misc_feature 1..366: note = Synthetic
  source 1..366: mol_type = other DNA
cagctgcagctgcaggagtcgggcccgggactggtgaagtcttcggagaccctgtccctcacctgcactgtttctgcttccatcaccggtagtacttactactggggctggatccgccagcccccagggaagggactggagtggatcgggagtatctattatagtgggaccacctactacaaagcgtcccttaagagtcgagtcacgatatccgtagacacgtccaagaaccaattctccctgaagctgacttctgtgactgtcgcagacacggctgtctattattgtgtgagtcatctactaggaaactaccacaagtacggtatggacgtctggggccaagggaccacggtcaccgtctcctca

SEQ ID NO: 288 - protein, 122 aa, synthetic construct
  REGION 1..122: note = Synthetic
QLQLQESGPGLVKSSETLSLTCTVSASITGSTYYWGWIRQPPGKGLEWIGSIYYSGTTYYKASLKSRVTISVDTSKNQFSLKLTSVTVADTAVYYCVSHLLGNYHKYGMDVWGQGTTVTVSS

SEQ ID NO: 289 - DNA, 27 bp, synthetic construct
  misc_feature 1..27: note = Synthetic
  source 1..27: mol_type = other DNA
gcttccatcaccggtagtacttactac

SEQ ID NO: 290 - protein, 9 aa, synthetic construct
  REGION 1..9: note = Synthetic
ASITGSTYY

SEQ ID NO: 291 - DNA, 21 bp, synthetic construct
  misc_feature 1..21: note = Synthetic
  source 1..21: mol_type = other DNA
atctattatagtgggaccacc

SEQ ID NO: 292 - protein, 7 aa, synthetic construct
  REGION 1..7: note = Synthetic
IYYSGTT

SEQ ID NO: 293 - DNA, 45 bp, synthetic construct
  misc_feature 1..45: note = Synthetic
  source 1..45: mol_type = other DNA
gtgagtcatctactaggaaactaccacaagtacggtatggacgtc

SEQ ID NO: 294 - protein, 15 aa, synthetic construct
  REGION 1..15: note = Synthetic
VSHLLGNYHKYGMDV

SEQ ID NO: 295 - DNA, 336 bp, synthetic construct
  misc_feature 1..336: note = Synthetic
  source 1..336: mol_type = other DNA
cagtctgtgctgactcagccaccctcagcgtctgggacccccgggcagagggtcaccatctcttgttctggaagcaggtccaatatcggaattaatactgtaaactggtaccagcagttcccaggaacggccctcaacctcctcatctttagtgataatcagcggccctcaggggtccctgaccgattctctggctccaagtctggcacctcagcctccctggccatcagtggtctccagtctgaggatgaggctgattattactgtgcagcatgggatgacagtctgaatggtcctgattgggtgttcggcggagggaccaagctgaccgtccta

SEQ ID NO: 296 - protein, 112 aa, synthetic construct
  REGION 1..112: note = Synthetic
QSVLTQPPSASGTPGQRVTISCSGSRSNIGINTVNWYQQFPGTALNLLIFSDNQRPSGVPDRFSGSKSGTSASLAISGLQSEDEADYYCAAWDDSLNGPDWVFGGGTKLTVL

SEQ ID NO: 297 - DNA, 24 bp, synthetic construct
  misc_feature 1..24: note = Synthetic
  source 1..24: mol_type = other DNA
aggtccaatatcggaattaatact

SEQ ID NO: 298 - protein, 8 aa, synthetic construct
  REGION 1..8: note = Synthetic
RSNIGINT

SEQ ID NO: 299-300 - skipped (2 entries)

SEQ ID NO: 301 - DNA, 39 bp, synthetic construct
  misc_feature 1..39: note = Synthetic
  source 1..39: mol_type = other DNA
gcagcatgggatgacagtctgaatggtcctgattgggtg

SEQ ID NO: 302 - protein, 13 aa, synthetic construct
  REGION 1..13: note = Synthetic
AAWDDSLNGPDWV

SEQ ID NO: 303 - DNA, 1359 bp, synthetic construct
  misc_feature 1..1359: note = Synthetic
  source 1..1359: mol_type = other DNA
cagctgcagctgcaggagtcgggcccgggactggtgaagtcttcggagaccctgtccctcacctgcactgtttctgcttccatcaccggtagtacttactactggggctggatccgccagcccccagggaagggactggagtggatcgggagtatctattatagtgggaccacctactacaaagcgtcccttaagagtcgagtcacgatatccgtagacacgtccaagaaccaattctccctgaagctgacttctgtgactgtcgcagacacggctgtctattattgtgtgagtcatctactaggaaactaccacaagtacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 304 - protein, 452 aa, synthetic construct
  REGION 1..452: note = Synthetic
QLQLQESGPGLVKSSETLSLTCTVSASITGSTYYWGWIRQPPGKGLEWIGSIYYSGTTYYKASLKSRVTISVDTSKNQFSLKLTSVTVADTAVYYCVSHLLGNYHKYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 305 - DNA, 657 bp, synthetic construct
  misc_feature 1..657: note = Synthetic
  source 1..657: mol_type = other DNA
cagtctgtgctgactcagccaccctcagcgtctgggacccccgggcagagggtcaccatctcttgttctggaagcaggtccaatatcggaattaatactgtaaactggtaccagcagttcccaggaacggccctcaacctcctcatctttagtgataatcagcggccctcaggggtccctgaccgattctctggctccaagtctggcacctcagcctccctggccatcagtggtctccagtctgaggatgaggctgattattactgtgcagcatgggatgacagtctgaatggtcctgattgggtgttcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 306 - protein, 218 aa, synthetic construct
  REGION 1..218: note = Synthetic
QSVLTQPPSASGTPGQRVTISCSGSRSNIGINTVNWYQQFPGTALNLLIFSDNQRPSGVPDRFSGSKSGTSASLAISGLQSEDEADYYCAAWDDSLNGPDWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 307 - DNA, 369 bp, synthetic construct
  misc_feature 1..369: note = Synthetic
  source 1..369: mol_type = other DNA
gaggtgcagctggtggagtctgggggagccttggtacagcctggggggtccctgagactctcctgtgcagcctctggattcccctttaccatctatgccatgacctgggtccgccaggctccagggaagggactggagtgggtctcagtcattactggtagtggtgatagcacatactacgcagactccgtgaagggccggttcaccatctccagagacaattccaagaacacactgtatctgcaaatgaacagcctgagagccgaggacacggccgtatattactgtgtgaaaactggagagggatttttctactactattatggtatggacgtctggggccaagggaccacggtcaccgtctcctca

SEQ ID NO: 308 - protein, 123 aa, synthetic construct
  REGION 1..123: note = Synthetic
EVQLVESGGALVQPGGSLRLSCAASGFPFTIYAMTWVRQAPGKGLEWVSVITGSGDSTYYADSVKGRFTISRDNSKNTLYLQMNSLRAEDTAVYYCVKTGEGFFYYYYGMDVWGQGTTVTVSS

SEQ ID NO: 309 - DNA, 24 bp, synthetic construct
  misc_feature 1..24: note = Synthetic
  source 1..24: mol_type = other DNA
ggattcccctttaccatctatgcc

SEQ ID NO: 310 - protein, 8 aa, synthetic construct
  REGION 1..8: note = Synthetic
GFPFTIYA

SEQ ID NO: 311 - DNA, 24 bp, synthetic construct
  misc_feature 1..24: note = Synthetic
  source 1..24: mol_type = other DNA
attactggtagtggtgatagcaca

SEQ ID NO: 312 - protein, 8 aa, synthetic construct
  REGION 1..8: note = Synthetic
ITGSGDST

SEQ ID NO: 313 - DNA, 48 bp, synthetic construct
  misc_feature 1..48: note = Synthetic
  source 1..48: mol_type = other DNA
gtgaaaactggagagggatttttctactactattatggtatggacgtc

SEQ ID NO: 314 - protein, 16 aa, synthetic construct
  REGION 1..16: note = Synthetic
VKTGEGFFYYYYGMDV

SEQ ID NO: 315 - DNA, 330 bp, synthetic construct
  misc_feature 1..330: note = Synthetic
  source 1..330: mol_type = other DNA
cagtctgtgttgacgcagccgccctcagtgtctgcggccccaggacagaaggtcaccatctcctgctctggaagcagctccaacattgggaatagttatatatcctggtaccagcagctcccaggaacagcccccaaactcctcatttatgtcaataataaacgaccctcagggattcctgaccgattctctggctccaagtctggcacgtcagccaccctgggcatcaccggactccagactggggacgaggccgattattactgcggaacatgggatagcagcctgagtgctggtgtgttcggcagtggcaccaaggtgaccgtcctc

SEQ ID NO: 316 - protein, 110 aa, synthetic construct
  REGION 1..110: note = Synthetic
QSVLTQPPSVSAAPGQKVTISCSGSSSNIGNSYISWYQQLPGTAPKLLIYVNNKRPSGIPDRFSGSKSGTSATLGITGLQTGDEADYYCGTWDSSLSAGVFGSGTKVTVL

SEQ ID NO: 317 - DNA, 24 bp, synthetic construct
  misc_feature 1..24: note = Synthetic
  source 1..24: mol_type = other DNA
agctccaacattgggaatagttat

SEQ ID NO: 318 - protein, 8 aa, synthetic construct
  REGION 1..8: note = Synthetic
SSNIGNSY

SEQ ID NO: 319-320 - skipped (2 entries)

SEQ ID NO: 321 - DNA, 33 bp, synthetic construct
  misc_feature 1..33: note = Synthetic
  source 1..33: mol_type = other DNA
ggaacatgggatagcagcctgagtgctggtgtg

SEQ ID NO: 322 - protein, 11 aa, synthetic construct
  REGION 1..11: note = Synthetic
GTWDSSLSAGV

SEQ ID NO: 323 - DNA, 1362 bp, synthetic construct
  misc_feature 1..1362: note = Synthetic
  source 1..1362: mol_type = other DNA
gaggtgcagctggtggagtctgggggagccttggtacagcctggggggtccctgagactctcctgtgcagcctctggattcccctttaccatctatgccatgacctgggtccgccaggctccagggaagggactggagtgggtctcagtcattactggtagtggtgatagcacatactacgcagactccgtgaagggccggttcaccatctccagagacaattccaagaacacactgtatctgcaaatgaacagcctgagagccgaggacacggccgtatattactgtgtgaaaactggagagggatttttctactactattatggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 324 - protein, 453 aa, synthetic construct
  REGION 1..453: note = Synthetic
EVQLVESGGALVQPGGSLRLSCAASGFPFTIYAMTWVRQAPGKGLEWVSVITGSGDSTYYADSVKGRFTISRDNSKNTLYLQMNSLRAEDTAVYYCVKTGEGFFYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 325 - DNA, 651 bp, synthetic construct
  misc_feature 1..651: note = Synthetic
  source 1..651: mol_type = other DNA
cagtctgtgttgacgcagccgccctcagtgtctgcggccccaggacagaaggtcaccatctcctgctctggaagcagctccaacattgggaatagttatatatcctggtaccagcagctcccaggaacagcccccaaactcctcatttatgtcaataataaacgaccctcagggattcctgaccgattctctggctccaagtctggcacgtcagccaccctgggcatcaccggactccagactggggacgaggccgattattactgcggaacatgggatagcagcctgagtgctggtgtgttcggcagtggcaccaaggtgaccgtcctcggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 326 - protein, 216 aa, synthetic construct
  REGION 1..216: note = Synthetic
QSVLTQPPSVSAAPGQKVTISCSGSSSNIGNSYISWYQQLPGTAPKLLIYVNNKRPSGIPDRFSGSKSGTSATLGITGLQTGDEADYYCGTWDSSLSAGVFGSGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 327 - DNA, 363 bp, synthetic construct
  misc_feature 1..363: note = Synthetic
  source 1..363: mol_type = other DNA
gaggtgcagctggtggagtctgggggaggcttggtccagcctggggggtccctgagactctcctgtgcagcctctggattctcctttagtagcaattggatgagctgggtccgccaggctccagggaaggggctggagtgggtgggcaacataaaccaagatggaagtgagaaatactatgtggactctgtggagggccgattcaccatctccagagacaacgccaagaagtcactgtatctgcaaatgaacagcctgagagccgaggacacggctgtgtattactgtgcgagagatttaggtgtactatggttcggggacttcgtcgactggggccagggagccctggtcaccgtctcctca

SEQ ID NO: 328 - protein, 121 aa, synthetic construct
  REGION 1..121: note = Synthetic
EVQLVESGGGLVQPGGSLRLSCAASGFSFSSNWMSWVRQAPGKGLEWVGNINQDGSEKYYVDSVEGRFTISRDNAKKSLYLQMNSLRAEDTAVYYCARDLGVLWFGDFVDWGQGALVTVSS

SEQ ID NO: 329 - DNA, 24 bp, synthetic construct
  misc_feature 1..24: note = Synthetic
  source 1..24: mol_type = other DNA
ggattctcctttagtagcaattgg

SEQ ID NO: 330 - protein, 8 aa, synthetic construct
  REGION 1..8: note = Synthetic
GFSFSSNW

SEQ ID NO: 331 - DNA, 24 bp, synthetic construct
  misc_feature 1..24: note = Synthetic
  source 1..24: mol_type = other DNA
ataaaccaagatggaagtgagaaa

SEQ ID NO: 332 - protein, 8 aa, synthetic construct
  REGION 1..8: note = Synthetic
INQDGSEK

SEQ ID NO: 333 - DNA, 42 bp, synthetic construct
  misc_feature 1..42: note = Synthetic
  source 1..42: mol_type = other DNA
gcgagagatttaggtgtactatggttcggggacttcgtcgac

SEQ ID NO: 334 - protein, 14 aa, synthetic construct
  REGION 1..14: note = Synthetic
ARDLGVLWFGDFVD

SEQ ID NO: 335 - DNA, 321 bp, synthetic construct
  misc_feature 1..321: note = Synthetic
  source 1..321: mol_type = other DNA
gacatccagatgacccagtctccatcctccctgtctgcatctgtaggagacagagtcaccatcacttgccgggcgagtcaggccattagcaattctttagcctggtatcagcagaaaccagggaaagcccctaagctcctgctctatgctgcatccacattggaaagtggggtcccatccaggttcagtggcagtggatctgggacggattacactctcaccatcagcagcctgcagcctgaagattttgccacttattactgtctacagtattatggttcccctcggacgttcggccaagggaccaaggtggaaatcaaa

SEQ ID NO: 336 - protein, 107 aa, synthetic construct
  REGION 1..107: note = Synthetic
DIQMTQSPSSLSASVGDRVTITCRASQAISNSLAWYQQKPGKAPKLLLYAASTLESGVPSRFSGSGSGTDYTLTISSLQPEDFATYYCLQYYGSPRTFGQGTKVEIK

SEQ ID NO: 337 - DNA, 18 bp, synthetic construct
  misc_feature 1..18: note = Synthetic
  source 1..18: mol_type = other DNA
caggccattagcaattct

SEQ ID NO: 338 - protein, 6 aa, synthetic construct
  REGION 1..6: note = Synthetic
QAISNS

SEQ ID NO: 339 - DNA, 27 bp, synthetic construct
  misc_feature 1..27: note = Synthetic
  source 1..27: mol_type = other DNA
ctacagtattatggttcccctcggacg

SEQ ID NO: 340 - protein, 9 aa, synthetic construct
  REGION 1..9: note = Synthetic
LQYYGSPRT

SEQ ID NO: 341 - DNA, 1356 bp, synthetic construct
  misc_feature 1..1356: note = Synthetic
  source 1..1356: mol_type = other DNA
gaggtgcagctggtggagtctgggggaggcttggtccagcctggggggtccctgagactctcctgtgcagcctctggattctcctttagtagcaattggatgagctgggtccgccaggctccagggaaggggctggagtgggtgggcaacataaaccaagatggaagtgagaaatactatgtggactctgtggagggccgattcaccatctccagagacaacgccaagaagtcactgtatctgcaaatgaacagcctgagagccgaggacacggctgtgtattactgtgcgagagatttaggtgtactatggttcggggacttcgtcgactggggccagggagccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 342 - protein, 451 aa, synthetic construct
  REGION 1..451: note = Synthetic
EVQLVESGGGLVQPGGSLRLSCAASGFSFSSNWMSWVRQAPGKGLEWVGNINQDGSEKYYVDSVEGRFTISRDNAKKSLYLQMNSLRAEDTAVYYCARDLGVLWFGDFVDWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 343 - DNA, 645 bp, synthetic construct
  misc_feature 1..645: note = Synthetic
  source 1..645: mol_type = other DNA
gacatccagatgacccagtctccatcctccctgtctgcatctgtaggagacagagtcaccatcacttgccgggcgagtcaggccattagcaattctttagcctggtatcagcagaaaccagggaaagcccctaagctcctgctctatgctgcatccacattggaaagtggggtcccatccaggttcagtggcagtggatctgggacggattacactctcaccatcagcagcctgcagcctgaagattttgccacttattactgtctacagtattatggttcccctcggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 344 - protein, 214 aa, synthetic construct
  REGION 1..214: note = Synthetic
DIQMTQSPSSLSASVGDRVTITCRASQAISNSLAWYQQKPGKAPKLLLYAASTLESGVPSRFSGSGSGTDYTLTISSLQPEDFATYYCLQYYGSPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 345 - DNA, 351 bp, synthetic construct
  misc_feature 1..351: note = Synthetic
  source 1..351: mol_type = other DNA
gaggtgcagctggtggagtctgggggaggcttggtccagcctggggggtccctgagactctcctgtgcagcctctggaatcaccgtcagtagcaactacatgacctgggtccgccaggctccagggaagggactggagtgggtctcacttatttatagcggtggaagcacattctacgcagactccgtcaggggccgattcaccatctccagagacaattccaagaacacgctgtatcttcaaatgaacagcctgagagctgaggacacggctgtgtattactgtgcgagagacctcgtcgtttacggtatggacgtctggggccaagggaccacggtcaccgtctcctca

SEQ ID NO: 346 - protein, 117 aa, synthetic construct
  REGION 1..117: note = Synthetic
EVQLVESGGGLVQPGGSLRLSCAASGITVSSNYMTWVRQAPGKGLEWVSLIYSGGSTFYADSVRGRFTISRDNSKNTLYLQMNSLRAEDTAVYYCARDLVVYGMDVWGQGTTVTVSS

SEQ ID NO: 347 - DNA, 24 bp, synthetic construct
  misc_feature 1..24: note = Synthetic
  source 1..24: mol_type = other DNA
ggaatcaccgtcagtagcaactac

SEQ ID NO: 348 - DNA, 21 bp, synthetic construct
  misc_feature 1..21: note = Synthetic
  source 1..21: mol_type = other DNA
atttatagcggtggaagcaca

SEQ ID NO: 349 - DNA, 33 bp, synthetic construct
  misc_feature 1..33: note = Synthetic
  source 1..33: mol_type = other DNA
gcgagagacctcgtcgtttacggtatggacgtc

SEQ ID NO: 350 - protein, 11 aa, synthetic construct
  REGION 1..11: note = Synthetic
ARDLVVYGMDV

SEQ ID NO: 351 - DNA, 321 bp, synthetic construct
  misc_feature 1..321: note = Synthetic
  source 1..321: mol_type = other DNA
gacatccagttgacccagtctccatcctccctgtctgcatctgtaggagacagagtcaccatcacttgccgggccagtcagggcattagcagttatttagcctggtaccagcaaaaaccagggaaagcccctaagctcctgatctatgctgcatccactttgcaaagtggggtcccgtcaaggttcagcggcagtggatctgggacagatttcactctcaccatcagcagcctgcagcctgaagattttgcaacttattactgtcaacaccttaatagtgaccctcacacttttggccaggggaccaagctggagatcaaa

SEQ ID NO: 352 - protein, 107 aa, synthetic construct
  REGION 1..107: note = Synthetic
DIQLTQSPSSLSASVGDRVTITCRASQGISSYLAWYQQKPGKAPKLLIYAASTLQSGVPSRFSGSGSGTDFTLTISSLQPEDFATYYCQHLNSDPHTFGQGTKLEIK

SEQ ID NO: 353 - DNA, 18 bp, synthetic construct
  misc_feature 1..18: note = Synthetic
  source 1..18: mol_type = other DNA
cagggcattagcagttat

SEQ ID NO: 354 - protein, 6 aa, synthetic construct
  REGION 1..6: note = Synthetic
QGISSY

SEQ ID NO: 355 - DNA, 27 bp, synthetic construct
  misc_feature 1..27: note = Synthetic
  source 1..27: mol_type = other DNA
caacaccttaatagtgaccctcacact

SEQ ID NO: 356 - protein, 9 aa, synthetic construct
  REGION 1..9: note = Synthetic
QHLNSDPHT

SEQ ID NO: 357 - DNA, 1344 bp, synthetic construct
  misc_feature 1..1344: note = Synthetic
  source 1..1344: mol_type = other DNA
gaggtgcagctggtggagtctgggggaggcttggtccagcctggggggtccctgagactctcctgtgcagcctctggaatcaccgtcagtagcaactacatgacctgggtccgccaggctccagggaagggactggagtgggtctcacttatttatagcggtggaagcacattctacgcagactccgtcaggggccgattcaccatctccagagacaattccaagaacacgctgtatcttcaaatgaacagcctgagagctgaggacacggctgtgtattactgtgcgagagacctcgtcgtttacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 358 - protein, 447 aa, synthetic construct
  REGION 1..447: note = Synthetic
EVQLVESGGGLVQPGGSLRLSCAASGITVSSNYMTWVRQAPGKGLEWVSLIYSGGSTFYADSVRGRFTISRDNSKNTLYLQMNSLRAEDTAVYYCARDLVVYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 359 - DNA, 645 bp, synthetic construct
  misc_feature 1..645: note = Synthetic
  source 1..645: mol_type = other DNA
gacatccagttgacccagtctccatcctccctgtctgcatctgtaggagacagagtcaccatcacttgccgggccagtcagggcattagcagttatttagcctggtaccagcaaaaaccagggaaagcccctaagctcctgatctatgctgcatccactttgcaaagtggggtcccgtcaaggttcagcggcagtggatctgggacagatttcactctcaccatcagcagcctgcagcctgaagattttgcaacttattactgtcaacaccttaatagtgaccctcacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 360 - protein, 214 aa, synthetic construct
  REGION 1..214: note = Synthetic
DIQLTQSPSSLSASVGDRVTITCRASQGISSYLAWYQQKPGKAPKLLIYAASTLQSGVPSRFSGSGSGTDFTLTISSLQPEDFATYYCQHLNSDPHTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 361 - DNA, 369 bp, synthetic construct
  misc_feature 1..369: note = Synthetic
  source 1..369: mol_type = other DNA
gaggtgcagctggtggagtctgggggaggcttggtccagcctggggggtccctgagactctcctgttcagcctctggattcaccttcagtaggtacgctatgtactgggtccgccaggctccagggaagggactggaatatgtttcagctattagtagtgatgggggtagcacatacgacgcagactccgtgaagggcagattcaccatctccagagccaattccaagaacacgctgtaccttcaaatgagcagtctgagagctgaggacacggctgtgtattattgtgtgaaaggtctgcgggagttactctactactattacggaatggacgtctggggccaagggactacggtcaccgtctcctca

SEQ ID NO: 362 - protein, 123 aa, synthetic construct
  REGION 1..123: note = Synthetic
EVQLVESGGGLVQPGGSLRLSCSASGFTFSRYAMYWVRQAPGKGLEYVSAISSDGGSTYDADSVKGRFTISRANSKNTLYLQMSSLRAEDTAVYYCVKGLRELLYYYYGMDVWGQGTTVTVSS

SEQ ID NO: 363 - DNA, 24 bp, synthetic construct
  misc_feature 1..24: note = Synthetic
  source 1..24: mol_type = other DNA
ggattcaccttcagtaggtacgct

SEQ ID NO: 364 - protein, 8 aa, synthetic construct
  REGION 1..8: note = Synthetic
GFTFSRYA

SEQ ID NO: 365 - DNA, 24 bp, synthetic construct
  misc_feature 1..24: note = Synthetic
  source 1..24: mol_type = other DNA
attagtagtgatgggggtagcaca

SEQ ID NO: 366 - protein, 8 aa, synthetic construct
  REGION 1..8: note = Synthetic
ISSDGGST

SEQ ID NO: 367 - DNA, 48 bp, synthetic construct
  misc_feature 1..48: note = Synthetic
  source 1..48: mol_type = other DNA
gtgaaaggtctgcgggagttactctactactattacggaatggacgtc

SEQ ID NO: 368 - protein, 16 aa, synthetic construct
  REGION 1..16: note = Synthetic
VKGLRELLYYYYGMDV

SEQ ID NO: 369 - DNA, 321 bp, synthetic construct
  misc_feature 1..321: note = Synthetic
  source 1..321: mol_type = other DNA
gacatccagatgacccagtctccatcctccctgtctgcatctgtaggagacagagtcaccatcacttgccgggcaggtcagagcattagcagctttttaaattggtatcagcagaagccagggaaagcccctaagctcctgatctatgctgcatccagtttgcaaagtggggtcccatcaaggttcagtggcagtggatctgggacagatttcactctcaccatcagcagtctccaacctgaagattttgcaacttactactgtcaacagagttacattacccccttcactttcggccctgggaccaaggtggatatcaaa

SEQ ID NO: 370 - protein, 107 aa, synthetic construct
  REGION 1..107: note = Synthetic
DIQMTQSPSSLSASVGDRVTITCRAGQSISSFLNWYQQKPGKAPKLLIYAASSLQSGVPSRFSGSGSGTDFTLTISSLQPEDFATYYCQQSYITPFTFGPGTKVDIK

SEQ ID NO: 371 - DNA, 18 bp, synthetic construct
  misc_feature 1..18: note = Synthetic
  source 1..18: mol_type = other DNA
cagagcattagcagcttt

SEQ ID NO: 372 - protein, 6 aa, synthetic construct
  REGION 1..6: note = Synthetic
QSISSF

SEQ ID NO: 373 - DNA, 27 bp, synthetic construct
  misc_feature 1..27: note = Synthetic
  source 1..27: mol_type = other DNA
caacagagttacattacccccttcact

SEQ ID NO: 374 - protein, 9 aa, synthetic construct
  REGION 1..9: note = Synthetic
QQSYITPFT

SEQ ID NO: 375 - DNA, 1362 bp, synthetic construct
  misc_feature 1..1362: note = Synthetic
  source 1..1362: mol_type = other DNA
gaggtgcagctggtggagtctgggggaggcttggtccagcctggggggtccctgagactctcctgttcagcctctggattcaccttcagtaggtacgctatgtactgggtccgccaggctccagggaagggactggaatatgtttcagctattagtagtgatgggggtagcacatacgacgcagactccgtgaagggcagattcaccatctccagagccaattccaagaacacgctgtaccttcaaatgagcagtctgagagctgaggacacggctgtgtattattgtgtgaaaggtctgcgggagttactctactactattacggaatggacgtctggggccaagggactacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 376 - protein, 453 aa, synthetic construct
  REGION 1..453: note = Synthetic
EVQLVESGGGLVQPGGSLRLSCSASGFTFSRYAMYWVRQAPGKGLEYVSAISSDGGSTYDADSVKGRFTISRANSKNTLYLQMSSLRAEDTAVYYCVKGLRELLYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 377 - DNA, 645 bp, synthetic construct
  misc_feature 1..645: note = Synthetic
  source 1..645: mol_type = other DNA
gacatccagatgacccagtctccatcctccctgtctgcatctgtaggagacagagtcaccatcacttgccgggcaggtcagagcattagcagctttttaaattggtatcagcagaagccagggaaagcccctaagctcctgatctatgctgcatccagtttgcaaagtggggtcccatcaaggttcagtggcagtggatctgggacagatttcactctcaccatcagcagtctccaacctgaagattttgcaacttactactgtcaacagagttacattacccccttcactttcggccctgggaccaaggtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 378 - protein, 214 aa, synthetic construct
  REGION 1..214: note = Synthetic
DIQMTQSPSSLSASVGDRVTITCRAGQSISSFLNWYQQKPGKAPKLLIYAASSLQSGVPSRFSGSGSGTDFTLTISSLQPEDFATYYCQQSYITPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 379 - DNA, 360 bp, synthetic construct
  misc_feature 1..360: note = Synthetic
  source 1..360: mol_type = other DNA
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtattttatactacgcagactctgtgaagggccgattcaccgcctccagagacaatgccaagaactcactgtatctgcaaatgaacagcctgagagccgaggatacgggtgtttattactgtgcgagacgggaataccagctacttagaccctttgaattctggggccagggaaccctggtcaccgtctcctca

SEQ ID NO: 380 - protein, 120 aa, synthetic construct
  REGION 1..120: note = Synthetic
EVQLVESGGGLVQPGGSLRLSCAASGFTFSSYEMNWVRQAPGKGLEWVSYISSSGSILYYADSVKGRFTASRDNAKNSLYLQMNSLRAEDTGVYYCARREYQLLRPFEFWGQGTLVTVSS

SEQ ID NO: 381 - DNA, 24 bp, synthetic construct
  misc_feature 1..24: note = Synthetic
  source 1..24: mol_type = other DNA
ggattcaccttcagtagttatgaa

SEQ ID NO: 382 - protein, 8 aa, synthetic construct
  REGION 1..8: note = Synthetic
GFTFSSYE

SEQ ID NO: 383 - DNA, 24 bp, synthetic construct
  misc_feature 1..24: note = Synthetic
  source 1..24: mol_type = other DNA
attagtagtagtggtagtatttta

SEQ ID NO: 384 - protein, 8 aa, synthetic construct
  REGION 1..8: note = Synthetic
ISSSGSIL

SEQ ID NO: 385 - DNA, 39 bp, synthetic construct
  misc_feature 1..39: note = Synthetic
  source 1..39: mol_type = other DNA
gcgagacgggaataccagctacttagaccctttgaattc

SEQ ID NO: 386 - protein, 13 aa, synthetic construct
  REGION 1..13: note = Synthetic
ARREYQLLRPFEF

SEQ ID NO: 387 - DNA, 324 bp, synthetic construct
  misc_feature 1..324: note = Synthetic
  source 1..324: mol_type = other DNA
gacatccagatgacccagtctccttccaccctgtctgcatctgtaggagacagagtcaccatcacttgccgggccagtcagagtattagtagctggttggcctggtatcagcagaaatcagggaaagcccctaagctcctgatctataaggcatctagtttagaaagtggggtcccatctaggttcagcggcagtggatctgggacagaattcactctcaccatcagcagcctgcagcctgatgattttgcaacttattactgccaacagtatgatagttattctccgtggacgttcggccaagggaccaaggtggaaatcaaa

SEQ ID NO: 388 - protein, 108 aa, synthetic construct
  REGION 1..108: note = Synthetic
DIQMTQSPSTLSASVGDRVTITCRASQSISSWLAWYQQKSGKAPKLLIYKASSLESGVPSRFSGSGSGTEFTLTISSLQPDDFATYYCQQYDSYSPWTFGQGTKVEIK

SEQ ID NO: 389 - DNA, 18 bp, synthetic construct
  misc_feature 1..18: note = Synthetic
  source 1..18: mol_type = other DNA
cagagtattagtagctgg

SEQ ID NO: 390 - protein, 6 aa, synthetic construct
  REGION 1..6: note = Synthetic
QSISSW

SEQ ID NO: 391-392 - skipped (2 entries)

SEQ ID NO: 393 - DNA, 30 bp, synthetic construct
  misc_feature 1..30: note = Synthetic
  source 1..30: mol_type = other DNA
caacagtatgatagttattctccgtggacg

SEQ ID NO: 394 - protein, 10 aa, synthetic construct
  REGION 1..10: note = Synthetic
QQYDSYSPWT

SEQ ID NO: 395 - DNA, 1353 bp, synthetic construct
  misc_feature 1..1353: note = Synthetic
  source 1..1353: mol_type = other DNA
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtattttatactacgcagactctgtgaagggccgattcaccgcctccagagacaatgccaagaactcactgtatctgcaaatgaacagcctgagagccgaggatacgggtgtttattactgtgcgagacgggaataccagctacttagaccctttgaattctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 396 - protein, 450 aa, synthetic construct
  REGION 1..450: note = Synthetic
EVQLVESGGGLVQPGGSLRLSCAASGFTFSSYEMNWVRQAPGKGLEWVSYISSSGSILYYADSVKGRFTASRDNAKNSLYLQMNSLRAEDTGVYYCARREYQLLRPFEFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 397 - DNA, 648 bp, synthetic construct
  misc_feature 1..648: note = Synthetic
  source 1..648: mol_type = other DNA
gacatccagatgacccagtctccttccaccctgtctgcatctgtaggagacagagtcaccatcacttgccgggccagtcagagtattagtagctggttggcctggtatcagcagaaatcagggaaagcccctaagctcctgatctataaggcatctagtttagaaagtggggtcccatctaggttcagcggcagtggatctgggacagaattcactctcaccatcagcagcctgcagcctgatgattttgcaacttattactgccaacagtatgatagttattctccgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 398 - protein, 215 aa, synthetic construct
  REGION 1..215: note = Synthetic
DIQMTQSPSTLSASVGDRVTITCRASQSISSWLAWYQQKSGKAPKLLIYKASSLESGVPSRFSGSGSGTEFTLTISSLQPDDFATYYCQQYDSYSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 399 - DNA, 348 bp, synthetic construct
  misc_feature 1..348: note = Synthetic
  source 1..348: mol_type = other DNA
gaggtgcagctggtggagactggaggaggcttgatccagcctggggggtccctgagactctcctgtgcagcctctgaattcattgtcagtcgcaactacatgagctgggtccgccaggctccagggaaggggctggagtgggtctcacttatttatagcggtggtagcacatactacgcagactccgtgaagggccgattcaccatctccagagacaattccaagaacatattatatcttcaaatgaacagcctgagagccgaggacacggccgtgtattactgtgcgagagaccgcggggggatttccgactactggggccagggaaccctggtcaccgtctcctca

SEQ ID NO: 400 - protein, 116 aa, synthetic construct
  REGION 1..116: note = Synthetic
EVQLVETGGGLIQPGGSLRLSCAASEFIVSRNYMSWVRQAPGKGLEWVSLIYSGGSTYYADSVKGRFTISRDNSKNILYLQMNSLRAEDTAVYYCARDRGGISDYWGQGTLVTVSS

SEQ ID NO: 401 - DNA, 24 bp, synthetic construct
  misc_feature 1..24: note = Synthetic
  source 1..24: mol_type = other DNA
gaattcattgtcagtcgcaactac

SEQ ID NO: 402 - protein, 8 aa, synthetic construct
  REGION 1..8: note = Synthetic
EFIVSRNY

SEQ ID NO: 403 - DNA, 21 bp, synthetic construct
  misc_feature 1..21: note = Synthetic
  source 1..21: mol_type = other DNA
atttatagcggtggtagcaca

SEQ ID NO: 404 - DNA, 30 bp, synthetic construct
  misc_feature 1..30: note = Synthetic
  source 1..30: mol_type = other DNA
gcgagagaccgcggggggatttccgactac

SEQ ID NO: 405 - protein, 10 aa, synthetic construct
  REGION 1..10: note = Synthetic
ARDRGGISDY

SEQ ID NO: 406 - DNA, 321 bp, synthetic construct
  misc_feature 1..321: note = Synthetic
  source 1..321: mol_type = other DNA
gacatccagatgacccagtctccatcctccctgtctgcatctgtaggagacagagtcaccatcacttgccaggcgagtcaggacattaacaagtatttaaattggtttcagcagaaaccagggaaagcccctaagctcctgatctacgatgcatccaatttggaaacaggggtcccatcaaggttcagtggaagtggatctggaacagattttactttcaccatcagcagcctgcagcctgaagatattgcaacatattactgtcaacagtatgataatctccctcgaacttttggccaggggaccaagctggagatcaaa

SEQ ID NO: 407 - protein, 107 aa, synthetic construct
  REGION 1..107: note = Synthetic
DIQMTQSPSSLSASVGDRVTITCQASQDINKYLNWFQQKPGKAPKLLIYDASNLETGVPSRFSGSGSGTDFTFTISSLQPEDIATYYCQQYDNLPRTFGQGTKLEIK

SEQ ID NO: 408 - DNA, 18 bp, synthetic construct
  misc_feature 1..18: note = Synthetic
  source 1..18: mol_type = other DNA
caggacattaacaagtat

SEQ ID NO: 409 - protein, 6 aa, synthetic construct
  REGION 1..6: note = Synthetic
QDINKY

SEQ ID NO: 410 - DNA, 27 bp, synthetic construct
  misc_feature 1..27: note = Synthetic
  source 1..27: mol_type = other DNA
caacagtatgataatctccctcgaact

SEQ ID NO: 411 - protein, 9 aa, synthetic construct
  REGION 1..9: note = Synthetic
QQYDNLPRT

SEQ ID NO: 412 - DNA, 1341 bp, synthetic construct
  misc_feature 1..1341: note = Synthetic
  source 1..1341: mol_type = other DNA
gaggtgcagctggtggagactggaggaggcttgatccagcctggggggtccctgagactctcctgtgcagcctctgaattcattgtcagtcgcaactacatgagctgggtccgccaggctccagggaaggggctggagtgggtctcacttatttatagcggtggtagcacatactacgcagactccgtgaagggccgattcaccatctccagagacaattccaagaacatattatatcttcaaatgaacagcctgagagccgaggacacggccgtgtattactgtgcgagagaccgcggggggatttccgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 413 - protein, 446 aa, synthetic construct
  REGION 1..446: note = Synthetic
EVQLVETGGGLIQPGGSLRLSCAASEFIVSRNYMSWVRQAPGKGLEWVSLIYSGGSTYYADSVKGRFTISRDNSKNILYLQMNSLRAEDTAVYYCARDRGGISDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 414 - DNA, 645 bp, synthetic construct
  misc_feature 1..645: note = Synthetic
  source 1..645: mol_type = other DNA
gacatccagatgacccagtctccatcctccctgtctgcatctgtaggagacagagtcaccatcacttgccaggcgagtcaggacattaacaagtatttaaattggtttcagcagaaaccagggaaagcccctaagctcctgatctacgatgcatccaatttggaaacaggggtcccatcaaggttcagtggaagtggatctggaacagattttactttcaccatcagcagcctgcagcctgaagatattgcaacatattactgtcaacagtatgataatctccctcgaacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 415 - protein, 214 aa, synthetic construct
  REGION 1..214: note = Synthetic
DIQMTQSPSSLSASVGDRVTITCQASQDINKYLNWFQQKPGKAPKLLIYDASNLETGVPSRFSGSGSGTDFTFTISSLQPEDIATYYCQQYDNLPRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 416 - DNA, 366 bp, synthetic construct
  misc_feature 1..366: note = Synthetic
  source 1..366: mol_type = other DNA
caggtgcagctggtgcagtctggggctgaggtgaagaagcctggggcctcagtgagggtctcctgcaaggcttctggatacaccttcaccggcaactatatccactgggtgcgacaggcccctggacaagggcttgagtggatggcatggatcaaccctaacagtggtggcaaaaactatgcccagaagtttcagggcagggtcaccttgaccagggacacgtccgtcaatacagcctacatggagttgagcaggctgagatctgacgacacggccatgtattactgtgcgagagacgtgaattacaatattttgactggtccggggggcctatggggccagggaaccctggtcaccgtctcctca

SEQ ID NO: 417 - protein, 122 aa, synthetic construct
  REGION 1..122: note = Synthetic
QVQLVQSGAEVKKPGASVRVSCKASGYTFTGNYIHWVRQAPGQGLEWMAWINPNSGGKNYAQKFQGRVTLTRDTSVNTAYMELSRLRSDDTAMYYCARDVNYNILTGPGGLWGQGTLVTVSS

SEQ ID NO: 418 - DNA, 24 bp, synthetic construct
  misc_feature 1..24: note = Synthetic
  source 1..24: mol_type = other DNA
ggatacaccttcaccggcaactat

SEQ ID NO: 419 - protein, 8 aa, synthetic construct
  REGION 1..8: note = Synthetic
GYTFTGNY

SEQ ID NO: 420 - DNA, 24 bp, synthetic construct
  misc_feature 1..24: note = Synthetic
  source 1..24: mol_type = other DNA
atcaaccctaacagtggtggcaaa

SEQ ID NO: 421 - protein, 8 aa, synthetic construct
  REGION 1..8: note = Synthetic
INPNSGGK

SEQ ID NO: 422 - DNA, 45 bp, synthetic construct
  misc_feature 1..45: note = Synthetic
  source 1..45: mol_type = other DNA
gcgagagacgtgaattacaatattttgactggtccggggggccta

SEQ ID NO: 423 - protein, 15 aa, synthetic construct
  REGION 1..15: note = Synthetic
ARDVNYNILTGPGGL

SEQ ID NO: 424 - DNA, 330 bp, synthetic construct
  misc_feature 1..330: note = Synthetic
  source 1..330: mol_type = other DNA
cagtctgccctgactcagcctccctccgcgtccgggtctcctggacagtcagtcaccatctcctgcactggaaccagcagtgacgttggtggttataactttgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaattttgtcttcggaactgggaccaaggtcaccgtccta

SEQ ID NO: 425 - protein, 110 aa, synthetic construct
  REGION 1..110: note = Synthetic
QSALTQPPSASGSPGQSVTISCTGTSSDVGGYNFVSWYQQHPGKAPKLMIYEVSKRPSGVPDRFSGSKSGNTASLTVSGLQAEDEADYYCSSYAGSNNFVFGTGTKVTVL

SEQ ID NO: 426 - DNA, 27 bp, synthetic construct
  misc_feature 1..27: note = Synthetic
  source 1..27: mol_type = other DNA
agcagtgacgttggtggttataacttt

SEQ ID NO: 427 - protein, 9 aa, synthetic construct
  REGION 1..9: note = Synthetic
SSDVGGYNF

SEQ ID NO: 428 - DNA, 30 bp, synthetic construct
  misc_feature 1..30: note = Synthetic
  source 1..30: mol_type = other DNA
agctcatatgcaggcagcaacaattttgtc

SEQ ID NO: 429 - protein, 10 aa, synthetic construct
  REGION 1..10: note = Synthetic
SSYAGSNNFV

SEQ ID NO: 430 - DNA, 1359 bp, synthetic construct
  misc_feature 1..1359: note = Synthetic
  source 1..1359: mol_type = other DNA
caggtgcagctggtgcagtctggggctgaggtgaagaagcctggggcctcagtgagggtctcctgcaaggcttctggatacaccttcaccggcaactatatccactgggtgcgacaggcccctggacaagggcttgagtggatggcatggatcaaccctaacagtggtggcaaaaactatgcccagaagtttcagggcagggtcaccttgaccagggacacgtccgtcaatacagcctacatggagttgagcaggctgagatctgacgacacggccatgtattactgtgcgagagacgtgaattacaatattttgactggtccggggggcctatggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 431 - protein, 452 aa, synthetic construct
  REGION 1..452: note = Synthetic
QVQLVQSGAEVKKPGASVRVSCKASGYTFTGNYIHWVRQAPGQGLEWMAWINPNSGGKNYAQKFQGRVTLTRDTSVNTAYMELSRLRSDDTAMYYCARDVNYNILTGPGGLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 432 - DNA, 651 bp, synthetic construct
  misc_feature 1..651: note = Synthetic
  source 1..651: mol_type = other DNA
cagtctgccctgactcagcctccctccgcgtccgggtctcctggacagtcagtcaccatctcctgcactggaaccagcagtgacgttggtggttataactttgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaattttgtcttcggaactgggaccaaggtcaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 433 - protein, 216 aa, synthetic construct
  REGION 1..216: note = Synthetic
QSALTQPPSASGSPGQSVTISCTGTSSDVGGYNFVSWYQQHPGKAPKLMIYEVSKRPSGVPDRFSGSKSGNTASLTVSGLQAEDEADYYCSSYAGSNNFVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 434 - DNA, 366 bp, synthetic construct
  misc_feature 1..366: note = Synthetic
  source 1..366: mol_type = other DNA
caggtgcagctggtgcagtctggggctgacgtgaagaagcctggggcctcagtgaaggtctcctgcaagacttctggatacatcttcaccggctactatatacactgggtgcgacaggcccctggacaaggacttgagtggatgggatggatcaaccctaacagtggtggcacaaactctgcacagaagtttcagggcagggtcaccatgaccagggacacgtccatcagcacagtctacatggaactgagcaggctgagatctgacgacacggccgtgtattactgtgcgaaaagtaattctttctccgtcctggactacaactttgactactggggccagggaaccctggtcaccgtctcctca

SEQ ID NO: 435 - protein, 122 aa, synthetic construct
  REGION 1..122: note = Synthetic
QVQLVQSGADVKKPGASVKVSCKTSGYIFTGYYIHWVRQAPGQGLEWMGWINPNSGGTNSAQKFQGRVTMTRDTSISTVYMELSRLRSDDTAVYYCAKSNSFSVLDYNFDYWGQGTLVTVSS

SEQ ID NO: 436 - DNA, 24 bp, synthetic construct
  misc_feature 1..24: note = Synthetic
  source 1..24: mol_type = other DNA
ggatacatcttcaccggctactat

SEQ ID NO: 437 - protein, 8 aa, synthetic construct
  REGION 1..8: note = Synthetic
GYIFTGYY

SEQ ID NO: 438 - DNA, 24 bp, synthetic construct
  misc_feature 1..24: note = Synthetic
  source 1..24: mol_type = other DNA
atcaaccctaacagtggtggcaca

SEQ ID NO: 439 - DNA, 45 bp, synthetic construct
  misc_feature 1..45: note = Synthetic
  source 1..45: mol_type = other DNA
gcgaaaagtaattctttctccgtcctggactacaactttgactac

SEQ ID NO: 440 - protein, 15 aa, synthetic construct
  REGION 1..15: note = Synthetic
AKSNSFSVLDYNFDY

SEQ ID NO: 441 - DNA, 327 bp, synthetic construct
  misc_feature 1..327: note = Synthetic
  source 1..327: mol_type = other DNA
tcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatgataaaaacaaccggccctcagggatcccagaccgattctctggctccagctcaggaaacacagcttccttgaccatcactggggctcaggcggaagatgaggctgactattactgtaactctcgggacagcagtcgtaaccatcttgtggttttcggcggagggaccaagctgaccgtccta

SEQ ID NO: 442 - protein, 109 aa, synthetic construct
  REGION 1..109: note = Synthetic
SSELTQDPAVSVALGQTVRITCQGDSLRSYYASWYQQKPGQAPVLVIYDKNNRPSGIPDRFSGSSSGNTASLTITGAQAEDEADYYCNSRDSSRNHLVVFGGGTKLTVL

SEQ ID NO: 443 - DNA, 18 bp, synthetic construct
  misc_feature 1..18: note = Synthetic
  source 1..18: mol_type = other DNA
agcctcagaagctattat

SEQ ID NO: 444 - protein, 6 aa, synthetic construct
  REGION 1..6: note = Synthetic
SLRSYY

SEQ ID NO: 445-446 - skipped (2 entries)

SEQ ID NO: 447 - DNA, 36 bp, synthetic construct
  misc_feature 1..36: note = Synthetic
  source 1..36: mol_type = other DNA
aactctcgggacagcagtcgtaaccatcttgtggtt

SEQ ID NO: 448 - protein, 12 aa, synthetic construct
  REGION 1..12: note = Synthetic
NSRDSSRNHLVV

SEQ ID NO: 449 - DNA, 1359 bp, synthetic construct
  misc_feature 1..1359: note = Synthetic
  source 1..1359: mol_type = other DNA
caggtgcagctggtgcagtctggggctgacgtgaagaagcctggggcctcagtgaaggtctcctgcaagacttctggatacatcttcaccggctactatatacactgggtgcgacaggcccctggacaaggacttgagtggatgggatggatcaaccctaacagtggtggcacaaactctgcacagaagtttcagggcagggtcaccatgaccagggacacgtccatcagcacagtctacatggaactgagcaggctgagatctgacgacacggccgtgtattactgtgcgaaaagtaattctttctccgtcctggactacaactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 450 - protein, 452 aa, synthetic construct
  REGION 1..452: note = Synthetic
QVQLVQSGADVKKPGASVKVSCKTSGYIFTGYYIHWVRQAPGQGLEWMGWINPNSGGTNSAQKFQGRVTMTRDTSISTVYMELSRLRSDDTAVYYCAKSNSFSVLDYNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 451 - DNA, 648 bp, synthetic construct
  misc_feature 1..648: note = Synthetic
  source 1..648: mol_type = other DNA
tcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatgataaaaacaaccggccctcagggatcccagaccgattctctggctccagctcaggaaacacagcttccttgaccatcactggggctcaggcggaagatgaggctgactattactgtaactctcgggacagcagtcgtaaccatcttgtggttttcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 452 - protein, 215 aa, synthetic construct
  REGION 1..215: note = Synthetic
SSELTQDPAVSVALGQTVRITCQGDSLRSYYASWYQQKPGQAPVLVIYDKNNRPSGIPDRFSGSSSGNTASLTITGAQAEDEADYYCNSRDSSRNHLVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 453 - DNA, 366 bp, synthetic construct
  misc_feature 1..366: note = Synthetic
  source 1..366: mol_type = other DNA
caggtgcagctggtgcagtctggggctgaggtgaagaagcctggggcctcagtgaaggtctcctgcaaggcttctggatacatattcaccgaccactatatgcactgggtgcgacaggcccctggacaagggcttgagtggatgggatggatcaaccctaacagcggtgccacaaactatgcacagaactttcagggcagggtcaccatgaccagggacacgtccatcatcacagtctacatggaactgagcaggctgagatctgacgacacggccgtatattactgtgcgagagactcatctccttatatgattcgctacactatggacgtctggggccaagggaccacaatcaccgtctcctca

SEQ ID NO: 454 - protein, 122 aa, synthetic construct
  REGION 1..122: note = Synthetic
QVQLVQSGAEVKKPGASVKVSCKASGYIFTDHYMHWVRQAPGQGLEWMGWINPNSGATNYAQNFQGRVTMTRDTSIITVYMELSRLRSDDTAVYYCARDSSPYMIRYTMDVWGQGTTITVSS

SEQ ID NO: 455 - DNA, 24 bp, synthetic construct
  misc_feature 1..24: note = Synthetic
  source 1..24: mol_type = other DNA
ggatacatattcaccgaccactat

SEQ ID NO: 456 - protein, 8 aa, synthetic construct
  REGION 1..8: note = Synthetic
GYIFTDHY

SEQ ID NO: 457 - DNA, 24 bp, synthetic construct
  misc_feature 1..24: note = Synthetic
  source 1..24: mol_type = other DNA
atcaaccctaacagcggtgccaca

SEQ ID NO: 458 - protein, 8 aa, synthetic construct
  REGION 1..8: note = Synthetic
INPNSGAT

SEQ ID NO: 459 - DNA, 45 bp, synthetic construct
  misc_feature 1..45: note = Synthetic
  source 1..45: mol_type = other DNA
gcgagagactcatctccttatatgattcgctacactatggacgtc

SEQ ID NO: 460 - protein, 15 aa, synthetic construct
  REGION 1..15: note = Synthetic
ARDSSPYMIRYTMDV

SEQ ID NO: 461 - DNA, 333 bp, synthetic construct
  misc_feature 1..333: note = Synthetic
  source 1..333: mol_type = other DNA
cagtctgccctgactcagcctgcctccgtgtctgggtctcctggacagtcgatcaccatctcctgcactggaaccagcagtgatgttggcagttataaccttgtctcctggtaccaacagcacccaggcaaagcccccaaactcatgatttatgaactcactaagcggccctcaggggtttctaatcgcttctctggctccaagtctggcaacacggcctccctgacaatctctgggctccaggctgaggacgaggctgattattactgctcctcatatagaggtagtgtcactgatgtggtattcggcggagggaccaagctgaccgtccta

SEQ ID NO: 462 - protein, 111 aa, synthetic construct
  REGION 1..111: note = Synthetic
QSALTQPASVSGSPGQSITISCTGTSSDVGSYNLVSWYQQHPGKAPKLMIYELTKRPSGVSNRFSGSKSGNTASLTISGLQAEDEADYYCSSYRGSVTDVVFGGGTKLTVL

SEQ ID NO: 463 - DNA, 27 bp, synthetic construct
  misc_feature 1..27: note = Synthetic
  source 1..27: mol_type = other DNA
agcagtgatgttggcagttataacctt

SEQ ID NO: 464-465 - skipped (2 entries)

SEQ ID NO: 466 - DNA, 33 bp, synthetic construct
  misc_feature 1..33: note = Synthetic
  source 1..33: mol_type = other DNA
tcctcatatagaggtagtgtcactgatgtggta

SEQ ID NO: 467 - protein, 11 aa, synthetic construct
  REGION 1..11: note = Synthetic
SSYRGSVTDVV

SEQ ID NO: 468 - DNA, 1359 bp, synthetic construct
  misc_feature 1..1359: note = Synthetic
  source 1..1359: mol_type = other DNA
caggtgcagctggtgcagtctggggctgaggtgaagaagcctggggcctcagtgaaggtctcctgcaaggcttctggatacatattcaccgaccactatatgcactgggtgcgacaggcccctggacaagggcttgagtggatgggatggatcaaccctaacagcggtgccacaaactatgcacagaactttcagggcagggtcaccatgaccagggacacgtccatcatcacagtctacatggaactgagcaggctgagatctgacgacacggccgtatattactgtgcgagagactcatctccttatatgattcgctacactatggacgtctggggccaagggaccacaatcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 469 - protein, 452 aa, synthetic construct
  REGION 1..452: note = Synthetic
QVQLVQSGAEVKKPGASVKVSCKASGYIFTDHYMHWVRQAPGQGLEWMGWINPNSGATNYAQNFQGRVTMTRDTSIITVYMELSRLRSDDTAVYYCARDSSPYMIRYTMDVWGQGTTITVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 470 - DNA, 654 bp, synthetic construct
  misc_feature 1..654: note = Synthetic
  source 1..654: mol_type = other DNA
cagtctgccctgactcagcctgcctccgtgtctgggtctcctggacagtcgatcaccatctcctgcactggaaccagcagtgatgttggcagttataaccttgtctcctggtaccaacagcacccaggcaaagcccccaaactcatgatttatgaactcactaagcggccctcaggggtttctaatcgcttctctggctccaagtctggcaacacggcctccctgacaatctctgggctccaggctgaggacgaggctgattattactgctcctcatatagaggtagtgtcactgatgtggtattcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 471 - protein, 217 aa, synthetic construct
  REGION 1..217: note = Synthetic
QSALTQPASVSGSPGQSITISCTGTSSDVGSYNLVSWYQQHPGKAPKLMIYELTKRPSGVSNRFSGSKSGNTASLTISGLQAEDEADYYCSSYRGSVTDVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 472 - DNA, 354 bp, synthetic construct
  misc_feature 1..354: note = Synthetic
  source 1..354: mol_type = other DNA
caggtgcagctgcaggagtcgggcccaggactggtgaagccttcggggaccctgtccctcacctgcgatgtctctggtggctccatcagcagtaataattggtggagttgggtccgccagcgcccagggaaggggctgcagtggattggggaaatctatcataatgagaacaccaactacaacccgtccctcaagagtcgagtcatcatgtcaatagacaagtccaagaaccagttctccctgaagttgacctctgtgaccgccgcggacacggccgtatattattgtgcgagaggggacgtactggactggttcgacccctggggccagggaaccctggtcaccgtctcctca

SEQ ID NO: 473 - protein, 118 aa, synthetic construct
  REGION 1..118: note = Synthetic
QVQLQESGPGLVKPSGTLSLTCDVSGGSISSNNWWSWVRQRPGKGLQWIGEIYHNENTNYNPSLKSRVIMSIDKSKNQFSLKLTSVTAADTAVYYCARGDVLDWFDPWGQGTLVTVSS

SEQ ID NO: 474 - DNA, 27 bp, synthetic construct
  misc_feature 1..27: note = Synthetic
  source 1..27: mol_type = other DNA
ggtggctccatcagcagtaataattgg

SEQ ID NO: 475 - protein, 9 aa, synthetic construct
  REGION 1..9: note = Synthetic
GGSISSNNW

SEQ ID NO: 476 - DNA, 21 bp, synthetic construct
  misc_feature 1..21: note = Synthetic
  source 1..21: mol_type = other DNA
atctatcataatgagaacacc

SEQ ID NO: 477 - protein, 7 aa, synthetic construct
  REGION 1..7: note = Synthetic
IYHNENT

SEQ ID NO: 478 - DNA, 33 bp, synthetic construct
  misc_feature 1..33: note = Synthetic
  source 1..33: mol_type = other DNA
gcgagaggggacgtactggactggttcgacccc

SEQ ID NO: 479 - protein, 11 aa, synthetic construct
  REGION 1..11: note = Synthetic
ARGDVLDWFDP

SEQ ID NO: 480 - DNA, 330 bp, synthetic construct
  misc_feature 1..330: note = Synthetic
  source 1..330: mol_type = other DNA
cagtctgccctgactcagcctgcctccgtgtctgggtctcctggacagtcgaccaccatctcctgcactggaaccagcagtgacgttggtggttacaactatgtctcctggtatcaacaatacccaggcaaagcccccaaactcatgatttacgatgtcactaatcggccctctggggtttctcatcgcttctctggctccaagtctggcaacacggcctccctgaccatctctgggctccaggctgaggacgaggctgattattactgcagctcatatacaagcagcagcaccgtgatattcggcggagggaccaagctgaccgtccta

SEQ ID NO: 481 - protein, 110 aa, synthetic construct
  REGION 1..110: note = Synthetic
QSALTQPASVSGSPGQSTTISCTGTSSDVGGYNYVSWYQQYPGKAPKLMIYDVTNRPSGVSHRFSGSKSGNTASLTISGLQAEDEADYYCSSYTSSSTVIFGGGTKLTVL

SEQ ID NO: 482 - DNA, 27 bp, synthetic construct
  misc_feature 1..27: note = Synthetic
  source 1..27: mol_type = other DNA
agcagtgacgttggtggttacaactat

SEQ ID NO: 483 - protein, 9 aa, synthetic construct
  REGION 1..9: note = Synthetic
SSDVGGYNY

SEQ ID NO: 484-485 - skipped (2 entries)

SEQ ID NO: 486 - DNA, 30 bp, synthetic construct
  misc_feature 1..30: note = Synthetic
  source 1..30: mol_type = other DNA
agctcatatacaagcagcagcaccgtgata

SEQ ID NO: 487 - protein, 10 aa, synthetic construct
  REGION 1..10: note = Synthetic
SSYTSSSTVI

SEQ ID NO: 488 - DNA, 1347 bp, synthetic construct
  misc_feature 1..1347: note = Synthetic
  source 1..1347: mol_type = other DNA
caggtgcagctgcaggagtcgggcccaggactggtgaagccttcggggaccctgtccctcacctgcgatgtctctggtggctccatcagcagtaataattggtggagttgggtccgccagcgcccagggaaggggctgcagtggattggggaaatctatcataatgagaacaccaactacaacccgtccctcaagagtcgagtcatcatgtcaatagacaagtccaagaaccagttctccctgaagttgacctctgtgaccgccgcggacacggccgtatattattgtgcgagaggggacgtactggactggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 489 - protein, 448 aa, synthetic construct
  REGION 1..448: note = Synthetic
QVQLQESGPGLVKPSGTLSLTCDVSGGSISSNNWWSWVRQRPGKGLQWIGEIYHNENTNYNPSLKSRVIMSIDKSKNQFSLKLTSVTAADTAVYYCARGDVLDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 490 - DNA, 651 bp, synthetic construct
  misc_feature 1..651: note = Synthetic
  source 1..651: mol_type = other DNA
cagtctgccctgactcagcctgcctccgtgtctgggtctcctggacagtcgaccaccatctcctgcactggaaccagcagtgacgttggtggttacaactatgtctcctggtatcaacaatacccaggcaaagcccccaaactcatgatttacgatgtcactaatcggccctctggggtttctcatcgcttctctggctccaagtctggcaacacggcctccctgaccatctctgggctccaggctgaggacgaggctgattattactgcagctcatatacaagcagcagcaccgtgatattcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 491 - protein, 216 aa, synthetic construct
  REGION 1..216: note = Synthetic
QSALTQPASVSGSPGQSTTISCTGTSSDVGGYNYVSWYQQYPGKAPKLMIYDVTNRPSGVSHRFSGSKSGNTASLTISGLQAEDEADYYCSSYTSSSTVIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 492 - DNA, 357 bp, synthetic construct
  misc_feature 1..357: note = Synthetic
  source 1..357: mol_type = other DNA
cagatcaccttgaaggagtctggtcctacgctggtgaaacccacacagaccctcacgctgacctgcaccttctctgggttctcatttagcacttctggagtgggtgtgggctggatccgtcagcccccaggaaagaccctggagtggcttgcactcatttattgggatgatgataagcgctacagcccatctctgaagagcaggctcaccattaccaaggacacctccaaaaaccaggtggtccttacaatgaccaacatggaccctgtggacactgccacatatttctgtgcacaccatggaatacctacgatctttggctactggggccagggagccctggtcaccgtctcctca

SEQ ID NO: 493 - protein, 119 aa, synthetic construct
  REGION 1..119: note = Synthetic
QITLKESGPTLVKPTQTLTLTCTFSGFSFSTSGVGVGWIRQPPGKTLEWLALIYWDDDKRYSPSLKSRLTITKDTSKNQVVLTMTNMDPVDTATYFCAHHGIPTIFGYWGQGALVTVSS

SEQ ID NO: 494 - DNA, 30 bp, synthetic construct
  misc_feature 1..30: note = Synthetic
  source 1..30: mol_type = other DNA
gggttctcatttagcacttctggagtgggt

SEQ ID NO: 495 - protein, 10 aa, synthetic construct
  REGION 1..10: note = Synthetic
GFSFSTSGVG

SEQ ID NO: 496 - DNA, 21 bp, synthetic construct
  misc_feature 1..21: note = Synthetic
  source 1..21: mol_type = other DNA
atttattgggatgatgataag

SEQ ID NO: 497 - protein, 7 aa, synthetic construct
  REGION 1..7: note = Synthetic
IYWDDDK

SEQ ID NO: 498 - DNA, 33 bp, synthetic construct
  misc_feature 1..33: note = Synthetic
  source 1..33: mol_type = other DNA
gcacaccatggaatacctacgatctttggctac

SEQ ID NO: 499 - protein, 11 aa, synthetic construct
  REGION 1..11: note = Synthetic
AHHGIPTIFGY

SEQ ID NO: 500 - DNA, 327 bp, synthetic construct
  misc_feature 1..327: note = Synthetic
  source 1..327: mol_type = other DNA
cagtctgccctgactcagcctgcctccgtgtctgggtctcctggacagtcgatcaccatctcctgcactggaaccagcagtgaccttggtgtttttaactatgtctcctggtaccaacagcacccaggcaaagcccccaaactcatgatttatgaggtcactaatcggccctcaggggtttctaatcgcttctctggctccaagtctggcaacacggcctccctgaccatctctgggctccaggctgaggacgaggctgattattattgcagctcatatacaaccagcagcactgttttcggcggagggaccaagctgaccgtccta

SEQ ID NO: 501 - protein, 109 aa, synthetic construct
  REGION 1..109: note = Synthetic
QSALTQPASVSGSPGQSITISCTGTSSDLGVFNYVSWYQQHPGKAPKLMIYEVTNRPSGVSNRFSGSKSGNTASLTISGLQAEDEADYYCSSYTTSSTVFGGGTKLTVL

SEQ ID NO: 502 - DNA, 27 bp, synthetic construct
  misc_feature 1..27: note = Synthetic
  source 1..27: mol_type = other DNA
agcagtgaccttggtgtttttaactat

SEQ ID NO: 503 - protein, 9 aa, synthetic construct
  REGION 1..9: note = Synthetic
SSDLGVFNY

SEQ ID NO: 504-505 - skipped (2 entries)

SEQ ID NO: 506 - DNA, 27 bp, synthetic construct
  misc_feature 1..27: note = Synthetic
  source 1..27: mol_type = other DNA
agctcatatacaaccagcagcactgtt

SEQ ID NO: 507 - protein, 9 aa, synthetic construct
  REGION 1..9: note = Synthetic
SSYTTSSTV

SEQ ID NO: 508 - DNA, 1350 bp, synthetic construct
  misc_feature 1..1350: note = Synthetic
  source 1..1350: mol_type = other DNA
cagatcaccttgaaggagtctggtcctacgctggtgaaacccacacagaccctcacgctgacctgcaccttctctgggttctcatttagcacttctggagtgggtgtgggctggatccgtcagcccccaggaaagaccctggagtggcttgcactcatttattgggatgatgataagcgctacagcccatctctgaagagcaggctcaccattaccaaggacacctccaaaaaccaggtggtccttacaatgaccaacatggaccctgtggacactgccacatatttctgtgcacaccatggaatacctacgatctttggctactggggccagggagccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 509 - protein, 449 aa, synthetic construct
  REGION 1..449: note = Synthetic
QITLKESGPTLVKPTQTLTLTCTFSGFSFSTSGVGVGWIRQPPGKTLEWLALIYWDDDKRYSPSLKSRLTITKDTSKNQVVLTMTNMDPVDTATYFCAHHGIPTIFGYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 510 - DNA, 648 bp, synthetic construct
  misc_feature 1..648: note = Synthetic
  source 1..648: mol_type = other DNA
cagtctgccctgactcagcctgcctccgtgtctgggtctcctggacagtcgatcaccatctcctgcactggaaccagcagtgaccttggtgtttttaactatgtctcctggtaccaacagcacccaggcaaagcccccaaactcatgatttatgaggtcactaatcggccctcaggggtttctaatcgcttctctggctccaagtctggcaacacggcctccctgaccatctctgggctccaggctgaggacgaggctgattattattgcagctcatatacaaccagcagcactgttttcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 511 - protein, 215 aa, synthetic construct
  REGION 1..215: note = Synthetic
QSALTQPASVSGSPGQSITISCTGTSSDLGVFNYVSWYQQHPGKAPKLMIYEVTNRPSGVSNRFSGSKSGNTASLTISGLQAEDEADYYCSSYTTSSTVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 512 - DNA, 360 bp, synthetic construct
  misc_feature 1..360: note = Synthetic
  source 1..360: mol_type = other DNA
caggtgcagctggtgcagtctggggctgaggtgaagaagcctggggcctcagtgaaggtctcctgcaaggcttctggatacaccttcaccggctactttatacactgggtgcgacaggcccctggacaagggcttgagtggatgggatggatcagccctatcagtggtggcacaaactatgcacagaagtttcagggcagggtcaccgtgaccagggacacgtccatcaccacagcctacatggagctgagcagactgacatctgacgacacggccgtgtatcactgtgcgagagagggcggcacgtggaagggggactttgactactggggccagggaaccctggtcaccgtctcctca

SEQ ID NO: 513 - protein, 120 aa, synthetic construct
  REGION 1..120: note = Synthetic
QVQLVQSGAEVKKPGASVKVSCKASGYTFTGYFIHWVRQAPGQGLEWMGWISPISGGTNYAQKFQGRVTVTRDTSITTAYMELSRLTSDDTAVYHCAREGGTWKGDFDYWGQGTLVTVSS

SEQ ID NO: 514 - DNA, 24 bp, synthetic construct
  misc_feature 1..24: note = Synthetic
  source 1..24: mol_type = other DNA
ggatacaccttcaccggctacttt

SEQ ID NO: 515 - protein, 8 aa, synthetic construct
  REGION 1..8: note = Synthetic
GYTFTGYF

SEQ ID NO: 516 - DNA, 24 bp, synthetic construct
  misc_feature 1..24: note = Synthetic
  source 1..24: mol_type = other DNA
atcagccctatcagtggtggcaca

SEQ ID NO: 517 - protein, 8 aa, synthetic construct
  REGION 1..8: note = Synthetic
ISPISGGT

SEQ ID NO: 518 - DNA, 39 bp, synthetic construct
  misc_feature 1..39: note = Synthetic
  source 1..39: mol_type = other DNA
gcgagagagggcggcacgtggaagggggactttgactac

SEQ ID NO: 519 - protein, 13 aa, synthetic construct
  REGION 1..13: note = Synthetic
AREGGTWKGDFDY

SEQ ID NO: 520 - DNA, 330 bp, synthetic construct
  misc_feature 1..330: note = Synthetic
  source 1..330: mol_type = other DNA
cagtctgccctgactcagcctgcctccgtgtctgggtctcctgggcagtcgatcaccatctcctgcactggaaccagcagtgatgttgagagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctcctcatatgcaggtagtagcacttgggtgttcggcggagggaccaagctgaccgtccta

SEQ ID NO: 521 - protein, 110 aa, synthetic construct
  REGION 1..110: note = Synthetic
QSALTQPASVSGSPGQSITISCTGTSSDVESYNLVSWYQQHPGKAPKLMIYEGSKRPSGVSNRFSGSKSGNTASLTISGLQAEDEADYYCSSYAGSSTWVFGGGTKLTVL

SEQ ID NO: 522 - DNA, 27 bp, synthetic construct
  misc_feature 1..27: note = Synthetic
  source 1..27: mol_type = other DNA
agcagtgatgttgagagttataacctt

SEQ ID NO: 523 - protein, 9 aa, synthetic construct
  REGION 1..9: note = Synthetic
SSDVESYNL

SEQ ID NO: 524-525 - skipped (2 entries)

SEQ ID NO: 526 - DNA, 1353 bp, synthetic construct
  misc_feature 1..1353: note = Synthetic
  source 1..1353: mol_type = other DNA
caggtgcagctggtgcagtctggggctgaggtgaagaagcctggggcctcagtgaaggtctcctgcaaggcttctggatacaccttcaccggctactttatacactgggtgcgacaggcccctggacaagggcttgagtggatgggatggatcagccctatcagtggtggcacaaactatgcacagaagtttcagggcagggtcaccgtgaccagggacacgtccatcaccacagcctacatggagctgagcagactgacatctgacgacacggccgtgtatcactgtgcgagagagggcggcacgtggaagggggactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 527 - protein, 450 aa, synthetic construct
  REGION 1..450: note = Synthetic
QVQLVQSGAEVKKPGASVKVSCKASGYTFTGYFIHWVRQAPGQGLEWMGWISPISGGTNYAQKFQGRVTVTRDTSITTAYMELSRLTSDDTAVYHCAREGGTWKGDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 528 - DNA, 651 bp, synthetic construct
  misc_feature 1..651: note = Synthetic
  source 1..651: mol_type = other DNA
cagtctgccctgactcagcctgcctccgtgtctgggtctcctgggcagtcgatcaccatctcctgcactggaaccagcagtgatgttgagagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctcctcatatgcaggtagtagcacttgggtgttcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 529 - protein, 216 aa, synthetic construct
  REGION 1..216: note = Synthetic
QSALTQPASVSGSPGQSITISCTGTSSDVESYNLVSWYQQHPGKAPKLMIYEGSKRPSGVSNRFSGSKSGNTASLTISGLQAEDEADYYCSSYAGSSTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 530 - DNA, 366 bp, synthetic construct
  misc_feature 1..366: note = Synthetic
  source 1..366: mol_type = other DNA
caggtgcagctggtgcagtctggggctgaggtgaagaagcctggggcctcagtgaaggtctcctgcaaggcttctggatacaccttcaccgactactttatacactgggtgcgacaggcccctggacaagggctagagtggatgggatggatcaaccctaccagtggtggcacaaactatgcacagaagtttcggggcagggtcaccatgaccagagacacgtccatcagcacagcctacgtggaactgagcaggctgagatctgacgacacggccctctattactgtgcgagagatctccctttttactctgatactaagcagtttgactactggggccagggaaccctggtcaccgtctcctca

SEQ ID NO: 531 - protein, 122 aa, synthetic construct
  REGION 1..122: note = Synthetic
QVQLVQSGAEVKKPGASVKVSCKASGYTFTDYFIHWVRQAPGQGLEWMGWINPTSGGTNYAQKFRGRVTMTRDTSISTAYVELSRLRSDDTALYYCARDLPFYSDTKQFDYWGQGTLVTVSS

SEQ ID NO: 532 - DNA, 24 bp, synthetic construct
  misc_feature 1..24: note = Synthetic
  source 1..24: mol_type = other DNA
ggatacaccttcaccgactacttt

SEQ ID NO: 533 - protein, 8 aa, synthetic construct
  REGION 1..8: note = Synthetic
GYTFTDYF

SEQ ID NO: 534 - DNA, 24 bp, synthetic construct
  misc_feature 1..24: note = Synthetic
  source 1..24: mol_type = other DNA
atcaaccctaccagtggtggcaca

SEQ ID NO: 535 - protein, 8 aa, synthetic construct
  REGION 1..8: note = Synthetic
INPTSGGT

SEQ ID NO: 536 - DNA, 45 bp, synthetic construct
  misc_feature 1..45: note = Synthetic
  source 1..45: mol_type = other DNA
gcgagagatctccctttttactctgatactaagcagtttgactac

SEQ ID NO: 537 - protein, 15 aa, synthetic construct
  REGION 1..15: note = Synthetic
ARDLPFYSDTKQFDY

SEQ ID NO: 538 - DNA, 330 bp, synthetic construct
  misc_feature 1..330: note = Synthetic
  source 1..330: mol_type = other DNA
cagtctgccctgactcagcctgcctccgtgtctggatatcctggacagtcgatcaccatctcctgcactggaaccagcagtgacgttggtggttataactatgtctcctggtaccaacagcacccaggcaaagcccccaaactcatgatttttgatgtcagtaatcggccctcaggggtttctaatcgcttctctggctccaagtctggcaacacggcctccctgaccttctctgggctccaggctgaggacgaggctgattattactgcagctcatataccagcagcagcacccttgtgttcggcggagggaccaagctgaccgtccta

SEQ ID NO: 539 - protein, 110 aa, synthetic construct
  REGION 1..110: note = Synthetic
QSALTQPASVSGYPGQSITISCTGTSSDVGGYNYVSWYQQHPGKAPKLMIFDVSNRPSGVSNRFSGSKSGNTASLTFSGLQAEDEADYYCSSYTSSSTLVFGGGTKLTVL

SEQ ID NO: 540 - DNA, 27 bp, synthetic construct
  misc_feature 1..27: note = Synthetic
  source 1..27: mol_type = other DNA
agcagtgacgttggtggttataactat

SEQ ID NO: 541-542 - skipped (2 entries)

SEQ ID NO: 543 - DNA, 30 bp, synthetic construct
  misc_feature 1..30: note = Synthetic
  source 1..30: mol_type = other DNA
agctcatataccagcagcagcacccttgtg

SEQ ID NO: 544 - protein, 10 aa, synthetic construct
  REGION 1..10: note = Synthetic
SSYTSSSTLV

SEQ ID NO: 545 - DNA, 1359 bp, synthetic construct
  misc_feature 1..1359: note = Synthetic
  source 1..1359: mol_type = other DNA
caggtgcagctggtgcagtctggggctgaggtgaagaagcctggggcctcagtgaaggtctcctgcaaggcttctggatacaccttcaccgactactttatacactgggtgcgacaggcccctggacaagggctagagtggatgggatggatcaaccctaccagtggtggcacaaactatgcacagaagtttcggggcagggtcaccatgaccagagacacgtccatcagcacagcctacgtggaactgagcaggctgagatctgacgacacggccctctattactgtgcgagagatctccctttttactctgatactaagcagtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 546 - protein, 452 aa, synthetic construct
  REGION 1..452: note = Synthetic
QVQLVQSGAEVKKPGASVKVSCKASGYTFTDYFIHWVRQAPGQGLEWMGWINPTSGGTNYAQKFRGRVTMTRDTSISTAYVELSRLRSDDTALYYCARDLPFYSDTKQFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 547 - DNA, 651 bp, synthetic construct
  misc_feature 1..651: note = Synthetic
  source 1..651: mol_type = other DNA
cagtctgccctgactcagcctgcctccgtgtctggatatcctggacagtcgatcaccatctcctgcactggaaccagcagtgacgttggtggttataactatgtctcctggtaccaacagcacccaggcaaagcccccaaactcatgatttttgatgtcagtaatcggccctcaggggtttctaatcgcttctctggctccaagtctggcaacacggcctccctgaccttctctgggctccaggctgaggacgaggctgattattactgcagctcatataccagcagcagcacccttgtgttcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 548 - protein, 216 aa, synthetic construct
  REGION 1..216: note = Synthetic
QSALTQPASVSGYPGQSITISCTGTSSDVGGYNYVSWYQQHPGKAPKLMIFDVSNRPSGVSNRFSGSKSGNTASLTFSGLQAEDEADYYCSSYTSSSTLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 549 - DNA, 360 bp, synthetic construct
  misc_feature 1..360: note = Synthetic
  source 1..360: mol_type = other DNA
caggtgcagctggtgcagtctggggctgaggtgaagaagcctgggtcctcggtgaaggtctcctgcaaggcttctggaggcaccttcagcaacaatgctatcagctgggtgcgacaggcccctggacaagggcttgagtggatgggaaagatcatccctatccttggtataggaggcgacgcacagaagttccagggcagattcacgattaccgcggacaaatccacgagcacagcctacatggagctgagcagcctgaggtctgaggacacggccgtttattactgtgcgaactctggtgatagtaggccccacgcttttgatatttggggccaagggacaatggtcaccgtctcttca

SEQ ID NO: 550 - protein, 120 aa, synthetic construct
  REGION 1..120: note = Synthetic
QVQLVQSGAEVKKPGSSVKVSCKASGGTFSNNAISWVRQAPGQGLEWMGKIIPILGIGGDAQKFQGRFTITADKSTSTAYMELSSLRSEDTAVYYCANSGDSRPHAFDIWGQGTMVTVSS

SEQ ID NO: 551 - DNA, 24 bp, synthetic construct
  misc_feature 1..24: note = Synthetic
  source 1..24: mol_type = other DNA
ggaggcaccttcagcaacaatgct

SEQ ID NO: 552 - protein, 8 aa, synthetic construct
  REGION 1..8: note = Synthetic
GGTFSNNA

SEQ ID NO: 553 - DNA, 24 bp, synthetic construct
  misc_feature 1..24: note = Synthetic
  source 1..24: mol_type = other DNA
atcatccctatccttggtatagga

SEQ ID NO: 554 - protein, 8 aa, synthetic construct
  REGION 1..8: note = Synthetic
IIPILGIG

SEQ ID NO: 555 - DNA, 39 bp, synthetic construct
  misc_feature 1..39: note = Synthetic
  source 1..39: mol_type = other DNA
gcgaactctggtgatagtaggccccacgcttttgatatt

SEQ ID NO: 556 - protein, 13 aa, synthetic construct
  REGION 1..13: note = Synthetic
ANSGDSRPHAFDI

SEQ ID NO: 557 - DNA, 330 bp, synthetic construct
  misc_feature 1..330: note = Synthetic
  source 1..330: mol_type = other DNA
cagtctgccctgactcagcctgcctccgtgtctgggtctcctggacagtcgatcaccatctcctgcactggaaccagcagtgatgttgggagttataaccttgtctcctggtaccaacaacacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctcctcatatgcaggtagtaggcgggaggttttcggcggagggaccaagctgaccgtccta

SEQ ID NO: 558 - protein, 110 aa, synthetic construct
  REGION 1..110: note = Synthetic
QSALTQPASVSGSPGQSITISCTGTSSDVGSYNLVSWYQQHPGKAPKLMIYEVSKRPSGVSNRFSGSKSGNTASLTISGLQAEDEADYYCSSYAGSRREVFGGGTKLTVL

SEQ ID NO: 559 - DNA, 30 bp, synthetic construct
  misc_feature 1..30: note = Synthetic
  source 1..30: mol_type = other DNA
tcctcatatgcaggtagtaggcgggaggtt

SEQ ID NO: 560 - protein, 10 aa, synthetic construct
  REGION 1..10: note = Synthetic
SSYAGSRREV

SEQ ID NO: 561 - DNA, 1353 bp, synthetic construct
  misc_feature 1..1353: note = Synthetic
  source 1..1353: mol_type = other DNA
caggtgcagctggtgcagtctggggctgaggtgaagaagcctgggtcctcggtgaaggtctcctgcaaggcttctggaggcaccttcagcaacaatgctatcagctgggtgcgacaggcccctggacaagggcttgagtggatgggaaagatcatccctatccttggtataggaggcgacgcacagaagttccagggcagattcacgattaccgcggacaaatccacgagcacagcctacatggagctgagcagcctgaggtctgaggacacggccgtttattactgtgcgaactctggtgatagtaggccccacgcttttgatatttggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 562 - protein, 450 aa, synthetic construct
  REGION 1..450: note = Synthetic
QVQLVQSGAEVKKPGSSVKVSCKASGGTFSNNAISWVRQAPGQGLEWMGKIIPILGIGGDAQKFQGRFTITADKSTSTAYMELSSLRSEDTAVYYCANSGDSRPHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 563 - DNA, 651 bp, synthetic construct
  misc_feature 1..651: note = Synthetic
  source 1..651: mol_type = other DNA
cagtctgccctgactcagcctgcctccgtgtctgggtctcctggacagtcgatcaccatctcctgcactggaaccagcagtgatgttgggagttataaccttgtctcctggtaccaacaacacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctcctcatatgcaggtagtaggcgggaggttttcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 564 - protein, 216 aa, synthetic construct
  REGION 1..216: note = Synthetic
QSALTQPASVSGSPGQSITISCTGTSSDVGSYNLVSWYQQHPGKAPKLMIYEVSKRPSGVSNRFSGSKSGNTASLTISGLQAEDEADYYCSSYAGSRREVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 565 - DNA, 378 bp, synthetic construct
  misc_feature 1..378: note = Synthetic
  source 1..378: mol_type = other DNA
gaggtgcagctggtggagtctgggggaggcttggtacagcctggggggtcgctgagactctcctgtgcagcctctggattcaccctcagtagctacgacatgcactgggtccgccaagttataggaaaaggtctggagtgggtctcaactattggtacttctggtgacacatactatccaggctccgtgaagggccgattcaccatctccagagaaaatgccaagaactccttgtatcttcaaatgaacagcctgagagccggagacacggctgtgtattactgtgcaagggggggagtgccaactactatttggagcggaccatactactactacatggacgtctggggcaaagggaccacggtcaccgtctcctca

SEQ ID NO: 566 - protein, 126 aa, synthetic construct
  REGION 1..126: note = Synthetic
EVQLVESGGGLVQPGGSLRLSCAASGFTLSSYDMHWVRQVIGKGLEWVSTIGTSGDTYYPGSVKGRFTISRENAKNSLYLQMNSLRAGDTAVYYCARGGVPTTIWSGPYYYYMDVWGKGTTVTVSS

SEQ ID NO: 567 - DNA, 24 bp, synthetic construct
  misc_feature 1..24: note = Synthetic
  source 1..24: mol_type = other DNA
ggattcaccctcagtagctacgac

SEQ ID NO: 568 - protein, 8 aa, synthetic construct
  REGION 1..8: note = Synthetic
GFTLSSYD

SEQ ID NO: 569 - DNA, 21 bp, synthetic construct
  misc_feature 1..21: note = Synthetic
  source 1..21: mol_type = other DNA
attggtacttctggtgacaca

SEQ ID NO: 570 - protein, 7 aa, synthetic construct
  REGION 1..7: note = Synthetic
IGTSGDT

SEQ ID NO: 571 - DNA, 60 bp, synthetic construct
  misc_feature 1..60: note = Synthetic
  source 1..60: mol_type = other DNA
gcaagggggggagtgccaactactatttggagcggaccatactactactacatggacgtc

SEQ ID NO: 572 - protein, 20 aa, synthetic construct
  REGION 1..20: note = Synthetic
ARGGVPTTIWSGPYYYYMDV

SEQ ID NO: 573 - DNA, 336 bp, synthetic construct
  misc_feature 1..336: note = Synthetic
  source 1..336: mol_type = other DNA
cagtctgtgttgacgcagccgccctcagtgtctgcggccccaggacagaaggttaccatctcctgctctggaagcagctccaacattgggaataattatgtatcctggtaccagcagctcccaggaacagcccccaaactcctcatctatgaaaataataagcgaccctcagggattcctgaccgattctctggctccaagtctggcacgtcagccaccctgggcatcaccggactccagactggggacgaggccgattattactgcggaacatgggatagcagcctgagtgctggccagggagtattcggcggagggaccaagctgaccgtccta

SEQ ID NO: 574 - protein, 112 aa, synthetic construct
  REGION 1..112: note = Synthetic
QSVLTQPPSVSAAPGQKVTISCSGSSSNIGNNYVSWYQQLPGTAPKLLIYENNKRPSGIPDRFSGSKSGTSATLGITGLQTGDEADYYCGTWDSSLSAGQGVFGGGTKLTVL

SEQ ID NO: 575 - DNA, 24 bp, synthetic construct
  misc_feature 1..24: note = Synthetic
  source 1..24: mol_type = other DNA
agctccaacattgggaataattat

SEQ ID NO: 576 - protein, 8 aa, synthetic construct
  REGION 1..8: note = Synthetic
SSNIGNNY

SEQ ID NO: 577-578 - skipped (2 entries)

SEQ ID NO: 579 - DNA, 39 bp, synthetic construct
  misc_feature 1..39: note = Synthetic
  source 1..39: mol_type = other DNA
ggaacatgggatagcagcctgagtgctggccagggagta

SEQ ID NO: 580 - protein, 13 aa, synthetic construct
  REGION 1..13: note = Synthetic
GTWDSSLSAGQGV

SEQ ID NO: 581 - DNA, 1371 bp, synthetic construct
  misc_feature 1..1371: note = Synthetic
  source 1..1371: mol_type = other DNA
gaggtgcagctggtggagtctgggggaggcttggtacagcctggggggtcgctgagactctcctgtgcagcctctggattcaccctcagtagctacgacatgcactgggtccgccaagttataggaaaaggtctggagtgggtctcaactattggtacttctggtgacacatactatccaggctccgtgaagggccgattcaccatctccagagaaaatgccaagaactccttgtatcttcaaatgaacagcctgagagccggagacacggctgtgtattactgtgcaagggggggagtgccaactactatttggagcggaccatactactactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 582 - protein, 456 aa, synthetic construct
  REGION 1..456: note = Synthetic
EVQLVESGGGLVQPGGSLRLSCAASGFTLSSYDMHWVRQVIGKGLEWVSTIGTSGDTYYPGSVKGRFTISRENAKNSLYLQMNSLRAGDTAVYYCARGGVPTTIWSGPYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 583 - DNA, 657 bp, synthetic construct
  misc_feature 1..657: note = Synthetic
  source 1..657: mol_type = other DNA
cagtctgtgttgacgcagccgccctcagtgtctgcggccccaggacagaaggttaccatctcctgctctggaagcagctccaacattgggaataattatgtatcctggtaccagcagctcccaggaacagcccccaaactcctcatctatgaaaataataagcgaccctcagggattcctgaccgattctctggctccaagtctggcacgtcagccaccctgggcatcaccggactccagactggggacgaggccgattattactgcggaacatgggatagcagcctgagtgctggccagggagtattcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 584 - protein, 218 aa, synthetic construct
  REGION 1..218: note = Synthetic
QSVLTQPPSVSAAPGQKVTISCSGSSSNIGNNYVSWYQQLPGTAPKLLIYENNKRPSGIPDRFSGSKSGTSATLGITGLQTGDEADYYCGTWDSSLSAGQGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 585 - DNA, 354 bp, synthetic construct
  misc_feature 1..354: note = Synthetic
  source 1..354: mol_type = other DNA
caggttcagctggtgcagtctggacctgaggtgaagaagcccggggcctcagtgaaggtctcctgcaaggcttctggttacacctttaccagctatgctatcagctgggtgcgacaggcccctggacaagggcttgagtggatgggatggatcagcgcttacaatggtaacacaaactatgcacagaagctccagggcagagtcaccatgaccacagacacgttcacgagcacagcctacatggagctgaggagcctgagatctgacgacacggccgtttattactgtgctgtgccagcagaccacatcacgtttgactactggggccagggcaccctggtcaccgtctcctca

SEQ ID NO: 586 - protein, 118 aa, synthetic construct
  REGION 1..118: note = Synthetic
QVQLVQSGPEVKKPGASVKVSCKASGYTFTSYAISWVRQAPGQGLEWMGWISAYNGNTNYAQKLQGRVTMTTDTFTSTAYMELRSLRSDDTAVYYCAVPADHITFDYWGQGTLVTVSS

SEQ ID NO: 587 - DNA, 24 bp, synthetic construct
  misc_feature 1..24: note = Synthetic
  source 1..24: mol_type = other DNA
ggttacacctttaccagctatgct

SEQ ID NO: 588 - protein, 8 aa, synthetic construct
  REGION 1..8: note = Synthetic
GYTFTSYA

SEQ ID NO: 589 - DNA, 24 bp, synthetic construct
  misc_feature 1..24: note = Synthetic
  source 1..24: mol_type = other DNA
atcagcgcttacaatggtaacaca

SEQ ID NO: 590 - protein, 8 aa, synthetic construct
  REGION 1..8: note = Synthetic
ISAYNGNT

SEQ ID NO: 591 - DNA, 33 bp, synthetic construct
  misc_feature 1..33: note = Synthetic
  source 1..33: mol_type = other DNA
gctgtgccagcagaccacatcacgtttgactac

SEQ ID NO: 592 - protein, 11 aa, synthetic construct
  REGION 1..11: note = Synthetic
AVPADHITFDY

SEQ ID NO: 593 - DNA, 321 bp, synthetic construct
  misc_feature 1..321: note = Synthetic
  source 1..321: mol_type = other DNA
gaaattgtgttgacgcagtctccaggcaccctgtctttgtctccaggggaaagagccaccctctcctgcagggccagtcagagtgttagcagctacttagcctggtaccagcagaaacctggccaggctcccaggctcctcatccatggtgcatccagcagggccactggcatcccagacaggttcagtggcagtgggtctgggacagacttcactctcaccatcagcagactggagcctgaagattttgcagtgtattactgtcagcaatatggtagctctttcctcactttcggcggagggaccaaggtggagatcaaa

SEQ ID NO: 594 - protein, 107 aa, synthetic construct
  REGION 1..107: note = Synthetic
EIVLTQSPGTLSLSPGERATLSCRASQSVSSYLAWYQQKPGQAPRLLIHGASSRATGIPDRFSGSGSGTDFTLTISRLEPEDFAVYYCQQYGSSFLTFGGGTKVEIK

SEQ ID NO: 595 - DNA, 18 bp, synthetic construct
  misc_feature 1..18: note = Synthetic
  source 1..18: mol_type = other DNA
cagagtgttagcagctac

SEQ ID NO: 596 - protein, 6 aa, synthetic construct
  REGION 1..6: note = Synthetic
QSVSSY

SEQ ID NO: 597 - DNA, 27 bp, synthetic construct
  misc_feature 1..27: note = Synthetic
  source 1..27: mol_type = other DNA
cagcaatatggtagctctttcctcact

SEQ ID NO: 598 - protein, 9 aa, synthetic construct
  REGION 1..9: note = Synthetic
QQYGSSFLT

SEQ ID NO: 599 - DNA, 1347 bp, synthetic construct
  misc_feature 1..1347: note = Synthetic
  source 1..1347: mol_type = other DNA
caggttcagctggtgcagtctggacctgaggtgaagaagcccggggcctcagtgaaggtctcctgcaaggcttctggttacacctttaccagctatgctatcagctgggtgcgacaggcccctggacaagggcttgagtggatgggatggatcagcgcttacaatggtaacacaaactatgcacagaagctccagggcagagtcaccatgaccacagacacgttcacgagcacagcctacatggagctgaggagcctgagatctgacgacacggccgtttattactgtgctgtgccagcagaccacatcacgtttgactactggggccagggcaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 600 - protein, 448 aa, synthetic construct
  REGION 1..448: note = Synthetic
QVQLVQSGPEVKKPGASVKVSCKASGYTFTSYAISWVRQAPGQGLEWMGWISAYNGNTNYAQKLQGRVTMTTDTFTSTAYMELRSLRSDDTAVYYCAVPADHITFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 601 - DNA, 645 bp, synthetic construct
  misc_feature 1..645: note = Synthetic
  source 1..645: mol_type = other DNA
gaaattgtgttgacgcagtctccaggcaccctgtctttgtctccaggggaaagagccaccctctcctgcagggccagtcagagtgttagcagctacttagcctggtaccagcagaaacctggccaggctcccaggctcctcatccatggtgcatccagcagggccactggcatcccagacaggttcagtggcagtgggtctgggacagacttcactctcaccatcagcagactggagcctgaagattttgcagtgtattactgtcagcaatatggtagctctttcctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 602 - protein, 214 aa, synthetic construct
  REGION 1..214: note = Synthetic
EIVLTQSPGTLSLSPGERATLSCRASQSVSSYLAWYQQKPGQAPRLLIHGASSRATGIPDRFSGSGSGTDFTLTISRLEPEDFAVYYCQQYGSSFLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 603 - DNA, 366 bp, synthetic construct
  misc_feature 1..366: note = Synthetic
  source 1..366: mol_type = other DNA
caggtgcagctggtgcagtctggggctgaggtgaagaagcctgggtcctcggtgaaggtctcctgcaaggcttctggaggcagcttcagcaactatgctatcagttgggtgcgacaggcccctggacaagggcttgagtggatgggagggatcatccctttctttggaacaacaaactacgcacagaagttccagggcagactcacgattaccgcggacgaatccacgagcacattctacatggaactgagcagcctgggatctgaggacacggccgtgtattactgtgcggccgggtatagtagtggctggtacccttcctggttcgacccctggggccagggaaccctggtcaccgtctcctca

SEQ ID NO: 604 - protein, 122 aa, synthetic construct
  REGION 1..122: note = Synthetic
QVQLVQSGAEVKKPGSSVKVSCKASGGSFSNYAISWVRQAPGQGLEWMGGIIPFFGTTNYAQKFQGRLTITADESTSTFYMELSSLGSEDTAVYYCAAGYSSGWYPSWFDPWGQGTLVTVSS

SEQ ID NO: 605 - DNA, 24 bp, synthetic construct
  misc_feature 1..24: note = Synthetic
  source 1..24: mol_type = other DNA
ggaggcagcttcagcaactatgct

SEQ ID NO: 606 - protein, 8 aa, synthetic construct
  REGION 1..8: note = Synthetic
GGSFSNYA

SEQ ID NO: 607 - DNA, 24 bp, synthetic construct
  misc_feature 1..24: note = Synthetic
  source 1..24: mol_type = other DNA
atcatccctttctttggaacaaca

SEQ ID NO: 608 - protein, 8 aa, synthetic construct
  REGION 1..8: note = Synthetic
IIPFFGTT

SEQ ID NO: 609 - DNA, 45 bp, synthetic construct
  misc_feature 1..45: note = Synthetic
  source 1..45: mol_type = other DNA
gcggccgggtatagtagtggctggtacccttcctggttcgacccc

SEQ ID NO: 610 - protein, 15 aa, synthetic construct
  REGION 1..15: note = Synthetic
AAGYSSGWYPSWFDP

SEQ ID NO: 611 - DNA, 324 bp, synthetic construct
  misc_feature 1..324: note = Synthetic
  source 1..324: mol_type = other DNA
gaaattgtgttgacgcagtctccaggcaccctgtctttgtctccaggggaaagagccaccctctcctgtagggccagtcagagtgttaacaacaactacttagcctggtaccagcagaaacctggccagactcccaggctcctcatctatggtgcatccagcagggccactggcatcccagacaggttcagtggcagtgggtctgggacagacttcactctcaccatcaccagactggagcctgaagattttgcagtgtatcattgtcagcagtatggtaggtcaccgacaaccttcggccaagggacacgactggagattaaa

SEQ ID NO: 612 - protein, 108 aa, synthetic construct
  REGION 1..108: note = Synthetic
EIVLTQSPGTLSLSPGERATLSCRASQSVNNNYLAWYQQKPGQTPRLLIYGASSRATGIPDRFSGSGSGTDFTLTITRLEPEDFAVYHCQQYGRSPTTFGQGTRLEIK

SEQ ID NO: 613 - DNA, 21 bp, synthetic construct
  misc_feature 1..21: note = Synthetic
  source 1..21: mol_type = other DNA
cagagtgttaacaacaactac

SEQ ID NO: 614 - protein, 7 aa, synthetic construct
  REGION 1..7: note = Synthetic
QSVNNNY

SEQ ID NO: 615 - DNA, 27 bp, synthetic construct
  misc_feature 1..27: note = Synthetic
  source 1..27: mol_type = other DNA
cagcagtatggtaggtcaccgacaacc

SEQ ID NO: 616 - protein, 9 aa, synthetic construct
  REGION 1..9: note = Synthetic
QQYGRSPTT

SEQ ID NO: 617 - DNA, 1359 bp, synthetic construct
  misc_feature 1..1359: note = Synthetic
  source 1..1359: mol_type = other DNA
caggtgcagctggtgcagtctggggctgaggtgaagaagcctgggtcctcggtgaaggtctcctgcaaggcttctggaggcagcttcagcaactatgctatcagttgggtgcgacaggcccctggacaagggcttgagtggatgggagggatcatccctttctttggaacaacaaactacgcacagaagttccagggcagactcacgattaccgcggacgaatccacgagcacattctacatggaactgagcagcctgggatctgaggacacggccgtgtattactgtgcggccgggtatagtagtggctggtacccttcctggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 618 - protein, 452 aa, synthetic construct
  REGION 1..452: note = Synthetic
QVQLVQSGAEVKKPGSSVKVSCKASGGSFSNYAISWVRQAPGQGLEWMGGIIPFFGTTNYAQKFQGRLTITADESTSTFYMELSSLGSEDTAVYYCAAGYSSGWYPSWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 619 - DNA, 648 bp, synthetic construct
  misc_feature 1..648: note = Synthetic
  source 1..648: mol_type = other DNA
gaaattgtgttgacgcagtctccaggcaccctgtctttgtctccaggggaaagagccaccctctcctgtagggccagtcagagtgttaacaacaactacttagcctggtaccagcagaaacctggccagactcccaggctcctcatctatggtgcatccagcagggccactggcatcccagacaggttcagtggcagtgggtctgggacagacttcactctcaccatcaccagactggagcctgaagattttgcagtgtatcattgtcagcagtatggtaggtcaccgacaaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 620 - protein, 215 aa, synthetic construct
  REGION 1..215: note = Synthetic
EIVLTQSPGTLSLSPGERATLSCRASQSVNNNYLAWYQQKPGQTPRLLIYGASSRATGIPDRFSGSGSGTDFTLTITRLEPEDFAVYHCQQYGRSPTTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 621 - DNA, 372 bp, synthetic construct
  misc_feature 1..372: note = Synthetic
  source 1..372: mol_type = other DNA
gaggtccagctggtacagtctggggctgaggtgaagaagcctgggtctacaatgaaaatctcctgcaagatttctggatacatcttcagtgactactacatgcactgggtgcaacaggcccctggaaaagggcttgagtggatgggacttgttgatcctgaagatggtgagacaagatacgcagagaagttccagggcagagtcaccataaccgcggacacgtctacagacacagcctacatggagctgagcagcctcagatttgaggacacggccgtctattactgtgcaacagtcggggggagcagtggcccctggggcgaaaccctttttgaccactggggccagggatccctggtcaccgtctcctca

SEQ ID NO: 622 - protein, 124 aa, synthetic construct
  REGION 1..124: note = Synthetic
EVQLVQSGAEVKKPGSTMKISCKISGYIFSDYYMHWVQQAPGKGLEWMGLVDPEDGETRYAEKFQGRVTITADTSTDTAYMELSSLRFEDTAVYYCATVGGSSGPWGETLFDHWGQGSLVTVSS

SEQ ID NO: 623 - DNA, 24 bp, synthetic construct
  misc_feature 1..24: note = Synthetic
  source 1..24: mol_type = other DNA
ggatacatcttcagtgactactac

SEQ ID NO: 624 - protein, 8 aa, synthetic construct
  REGION 1..8: note = Synthetic
GYIFSDYY

SEQ ID NO: 625 - DNA, 24 bp, synthetic construct
  misc_feature 1..24: note = Synthetic
  source 1..24: mol_type = other DNA
gttgatcctgaagatggtgagaca

SEQ ID NO: 626 - protein, 8 aa, synthetic construct
  REGION 1..8: note = Synthetic
VDPEDGET

SEQ ID NO: 627 - DNA, 51 bp, synthetic construct
  misc_feature 1..51: note = Synthetic
  source 1..51: mol_type = other DNA
gcaacagtcggggggagcagtggcccctggggcgaaaccctttttgaccac

SEQ ID NO: 628 - protein, 17 aa, synthetic construct
  REGION 1..17: note = Synthetic
ATVGGSSGPWGETLFDH

SEQ ID NO: 629 - DNA, 336 bp, synthetic construct
  misc_feature 1..336: note = Synthetic
  source 1..336: mol_type = other DNA
gatattgtgatgactcagtctccactctccctgcccgtcacccctggagagccggcctccatctcctgcaggtctagtcagagcctcctgcatagtaatggatacaactatataaattggtacctgcagaagccagggcagtctccacagctcctgatgtatttgggttctaatcgggcctccggggtccctgacaggttcagtggcagtggatcaggcacagattctacactgaaaatcagcagagtggaggctgaggatgctggggtttattactgcatgcaaactcgacaaaccccgtacacttttggccaggggaccaagctggagatcaaa

SEQ ID NO: 630 - protein, 112 aa, synthetic construct
  REGION 1..112: note = Synthetic
DIVMTQSPLSLPVTPGEPASISCRSSQSLLHSNGYNYINWYLQKPGQSPQLLMYLGSNRASGVPDRFSGSGSGTDSTLKISRVEAEDAGVYYCMQTRQTPYTFGQGTKLEIK

SEQ ID NO: 631 - DNA, 33 bp, synthetic construct
  misc_feature 1..33: note = Synthetic
  source 1..33: mol_type = other DNA
cagagcctcctgcatagtaatggatacaactat

SEQ ID NO: 632 - protein, 11 aa, synthetic construct
  REGION 1..11: note = Synthetic
QSLLHSNGYNY

SEQ ID NO: 633-634 - skipped (2 entries)

SEQ ID NO: 635 - DNA, 27 bp, synthetic construct
  misc_feature 1..27: note = Synthetic
  source 1..27: mol_type = other DNA
atgcaaactcgacaaaccccgtacact

SEQ ID NO: 636 - protein, 9 aa, synthetic construct
  REGION 1..9: note = Synthetic
MQTRQTPYT

SEQ ID NO: 637 - DNA, 1365 bp, synthetic construct
  misc_feature 1..1365: note = Synthetic
  source 1..1365: mol_type = other DNA
gaggtccagctggtacagtctggggctgaggtgaagaagcctgggtctacaatgaaaatctcctgcaagatttctggatacatcttcagtgactactacatgcactgggtgcaacaggcccctggaaaagggcttgagtggatgggacttgttgatcctgaagatggtgagacaagatacgcagagaagttccagggcagagtcaccataaccgcggacacgtctacagacacagcctacatggagctgagcagcctcagatttgaggacacggccgtctattactgtgcaacagtcggggggagcagtggcccctggggcgaaaccctttttgaccactggggccagggatccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 638 - protein, 454 aa, synthetic construct
  REGION 1..454: note = Synthetic
EVQLVQSGAEVKKPGSTMKISCKISGYIFSDYYMHWVQQAPGKGLEWMGLVDPEDGETRYAEKFQGRVTITADTSTDTAYMELSSLRFEDTAVYYCATVGGSSGPWGETLFDHWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 639 - DNA, 660 bp, synthetic construct
  misc_feature 1..660: note = Synthetic
  source 1..660: mol_type = other DNA
gatattgtgatgactcagtctccactctccctgcccgtcacccctggagagccggcctccatctcctgcaggtctagtcagagcctcctgcatagtaatggatacaactatataaattggtacctgcagaagccagggcagtctccacagctcctgatgtatttgggttctaatcgggcctccggggtccctgacaggttcagtggcagtggatcaggcacagattctacactgaaaatcagcagagtggaggctgaggatgctggggtttattactgcatgcaaactcgacaaaccccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 640 - protein, 219 aa, synthetic construct
  REGION 1..219: note = Synthetic
DIVMTQSPLSLPVTPGEPASISCRSSQSLLHSNGYNYINWYLQKPGQSPQLLMYLGSNRASGVPDRFSGSGSGTDSTLKISRVEAEDAGVYYCMQTRQTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 641 - DNA, 378 bp, synthetic construct
  misc_feature 1..378: note = Synthetic
  source 1..378: mol_type = other DNA
gaggtgcagctggtggagtctgggggaggcttggtacagcctggagggtccctgagactctcctgtgtagcctctggattcgccttcagtacttatgaaatgaactgggtccgccaggctccagggaagggactggagtgggtttcatacattagtagtagtggtagtaccatatactacgcagactctgtgaagggccgactcaccatctccagagacaacgtcaagaactcactgtatctgcaaatgaacagcctgagagtcgaagacacggctatttattactgtgcgagagatgctataaggaataacgacattttgactgacccagcgacgttcgacccctggggccagggaaccctggtcaccgtctcctca

SEQ ID NO: 642 - protein, 126 aa, synthetic construct
  REGION 1..126: note = Synthetic
EVQLVESGGGLVQPGGSLRLSCVASGFAFSTYEMNWVRQAPGKGLEWVSYISSSGSTIYYADSVKGRLTISRDNVKNSLYLQMNSLRVEDTAIYYCARDAIRNNDILTDPATFDPWGQGTLVTVSS

SEQ ID NO: 643 - DNA, 24 bp, synthetic construct
  misc_feature 1..24: note = Synthetic
  source 1..24: mol_type = other DNA
ggattcgccttcagtacttatgaa

SEQ ID NO: 644 - protein, 8 aa, synthetic construct
  REGION 1..8: note = Synthetic
GFAFSTYE

SEQ ID NO: 645 - DNA, 24 bp, synthetic construct
  misc_feature 1..24: note = Synthetic
  source 1..24: mol_type = other DNA
attagtagtagtggtagtaccata

SEQ ID NO: 646 - protein, 8 aa, synthetic construct
  REGION 1..8: note = Synthetic
ISSSGSTI

SEQ ID NO: 647 - DNA, 57 bp, synthetic construct
  misc_feature 1..57: note = Synthetic
  source 1..57: mol_type = other DNA
gcgagagatgctataaggaataacgacattttgactgacccagcgacgttcgacccc

SEQ ID NO: 648 - protein, 19 aa, synthetic construct
  REGION 1..19: note = Synthetic
ARDAIRNNDILTDPATFDP

SEQ ID NO: 649 - DNA, 336 bp, synthetic construct
  misc_feature 1..336: note = Synthetic
  source 1..336: mol_type = other DNA
gatattgtgatgactcagtctccactctccctgcccgtcacccctggagagccggcctccatctcctgcaggtctagtcagagcctcctgtatagtaatggatacaactatttggattggtacttgcagaagccagggcagtctccacaactcctgatctctttgggatctaatcgggcctccggggtccctgacaggttcagtggcagtggatcaggcacagattttacactgaaaatcagcagagtggaggctgaggatgttggggtttattactgcatgcaagctctacaaactccgtacacttttggccaggggaccaagctggagatcaaa

SEQ ID NO: 650 - protein, 112 aa, synthetic construct
  REGION 1..112: note = Synthetic
DIVMTQSPLSLPVTPGEPASISCRSSQSLLYSNGYNYLDWYLQKPGQSPQLLISLGSNRASGVPDRFSGSGSGTDFTLKISRVEAEDVGVYYCMQALQTPYTFGQGTKLEIK

SEQ ID NO: 651 - DNA, 33 bp, synthetic construct
  misc_feature 1..33: note = Synthetic
  source 1..33: mol_type = other DNA
cagagcctcctgtatagtaatggatacaactat

SEQ ID NO: 652 - protein, 11 aa, synthetic construct
  REGION 1..11: note = Synthetic
QSLLYSNGYNY

SEQ ID NO: 653 - skipped

SEQ ID NO: 654 - DNA, 27 bp, synthetic construct
  misc_feature 1..27: note = Synthetic
  source 1..27: mol_type = other DNA
atgcaagctctacaaactccgtacact

SEQ ID NO: 655 - protein, 9 aa, synthetic construct
  REGION 1..9: note = Synthetic
MQALQTPYT

SEQ ID NO: 656 - DNA, 1371 bp, synthetic construct
  misc_feature 1..1371: note = Synthetic
  source 1..1371: mol_type = other DNA
gaggtgcagctggtggagtctgggggaggcttggtacagcctggagggtccctgagactctcctgtgtagcctctggattcgccttcagtacttatgaaatgaactgggtccgccaggctccagggaagggactggagtgggtttcatacattagtagtagtggtagtaccatatactacgcagactctgtgaagggccgactcaccatctccagagacaacgtcaagaactcactgtatctgcaaatgaacagcctgagagtcgaagacacggctatttattactgtgcgagagatgctataaggaataacgacattttgactgacccagcgacgttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 657 - protein, 456 aa, synthetic construct
  REGION 1..456: note = Synthetic
EVQLVESGGGLVQPGGSLRLSCVASGFAFSTYEMNWVRQAPGKGLEWVSYISSSGSTIYYADSVKGRLTISRDNVKNSLYLQMNSLRVEDTAIYYCARDAIRNNDILTDPATFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 658 - DNA, 660 bp, synthetic construct
  misc_feature 1..660: note = Synthetic
  source 1..660: mol_type = other DNA
gatattgtgatgactcagtctccactctccctgcccgtcacccctggagagccggcctccatctcctgcaggtctagtcagagcctcctgtatagtaatggatacaactatttggattggtacttgcagaagccagggcagtctccacaactcctgatctctttgggatctaatcgggcctccggggtccctgacaggttcagtggcagtggatcaggcacagattttacactgaaaatcagcagagtggaggctgaggatgttggggtttattactgcatgcaagctctacaaactccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 659 - protein, 219 aa, synthetic construct
  REGION 1..219: note = Synthetic
DIVMTQSPLSLPVTPGEPASISCRSSQSLLYSNGYNYLDWYLQKPGQSPQLLISLGSNRASGVPDRFSGSGSGTDFTLKISRVEAEDVGVYYCMQALQTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 660 - DNA, 390 bp, synthetic construct
  misc_feature 1..390: note = Synthetic
  source 1..390: mol_type = other DNA
caggtgcagctggtgcagtctggggctgaggtgaagaagcctggggcctcagtgaaggtttcctgcaaggcatctggatacaccttcaccaactactatatgcactgggtgcgacaggcccctggacaagggcttgagtggatgggaataatcaacccaagtggtggtagcacaagctacgcacagaagttcctgggcagagtcaccatgaccagggacacgtccacgaccacagtctacatggagctgagcagcctgagatctgaagacacggccgtgtatttctgtgcgagagtcgaaaacctccccaccaagtgggacctacttcgaaaggggtttgaatccggtatggacgtctggggccaagggaccacggtcaccgtctcctca

SEQ ID NO: 661 - protein, 130 aa, synthetic construct
  REGION 1..130: note = Synthetic
QVQLVQSGAEVKKPGASVKVSCKASGYTFTNYYMHWVRQAPGQGLEWMGIINPSGGSTSYAQKFLGRVTMTRDTSTTTVYMELSSLRSEDTAVYFCARVENLPTKWDLLRKGFESGMDVWGQGTTVTVSS

SEQ ID NO: 662 - DNA, 24 bp, synthetic construct
  misc_feature 1..24: note = Synthetic
  source 1..24: mol_type = other DNA
ggatacaccttcaccaactactat

SEQ ID NO: 663 - protein, 8 aa, synthetic construct
  REGION 1..8: note = Synthetic
GYTFTNYY

SEQ ID NO: 664 - DNA, 24 bp, synthetic construct
  misc_feature 1..24: note = Synthetic
  source 1..24: mol_type = other DNA
atcaacccaagtggtggtagcaca

SEQ ID NO: 665 - protein, 8 aa, synthetic construct
  REGION 1..8: note = Synthetic
INPSGGST

SEQ ID NO: 666 - DNA, 69 bp, synthetic construct
  misc_feature 1..69: note = Synthetic
  source 1..69: mol_type = other DNA
gcgagagtcgaaaacctccccaccaagtgggacctacttcgaaaggggtttgaatccggtatggacgtc

SEQ ID NO: 667 - protein, 23 aa, synthetic construct
  REGION 1..23: note = Synthetic
ARVENLPTKWDLLRKGFESGMDV

SEQ ID NO: 668 - DNA, 321 bp, synthetic construct
  misc_feature 1..321: note = Synthetic
  source 1..321: mol_type = other DNA
gaaatagtgatgacgcagtctccagccactgtgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccagcttcagtggcagtgggtctgggacagagttcactctcaccatcagcagcctgcagtctgaagattttgcagtttattactgtcagcagtataataactggccaatcactttcggccctgggaccaaagtggatatcaaa

SEQ ID NO: 669 - protein, 107 aa, synthetic construct
  REGION 1..107: note = Synthetic
EIVMTQSPATVSVSPGERATLSCRASQSVSSNLAWYQQKPGQAPRLLIYGASTRATGIPASFSGSGSGTEFTLTISSLQSEDFAVYYCQQYNNWPITFGPGTKVDIK

SEQ ID NO: 670 - DNA, 27 bp, synthetic construct
  misc_feature 1..27: note = Synthetic
  source 1..27: mol_type = other DNA
cagcagtataataactggccaatcact

SEQ ID NO: 671 - protein, 9 aa, synthetic construct
  REGION 1..9: note = Synthetic
QQYNNWPIT

SEQ ID NO: 672 - DNA, 1383 bp, synthetic construct
  misc_feature 1..1383: note = Synthetic
  source 1..1383: mol_type = other DNA
caggtgcagctggtgcagtctggggctgaggtgaagaagcctggggcctcagtgaaggtttcctgcaaggcatctggatacaccttcaccaactactatatgcactgggtgcgacaggcccctggacaagggcttgagtggatgggaataatcaacccaagtggtggtagcacaagctacgcacagaagttcctgggcagagtcaccatgaccagggacacgtccacgaccacagtctacatggagctgagcagcctgagatctgaagacacggccgtgtatttctgtgcgagagtcgaaaacctccccaccaagtgggacctacttcgaaaggggtttgaatccggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 673 - protein, 460 aa, synthetic construct
  REGION 1..460: note = Synthetic
QVQLVQSGAEVKKPGASVKVSCKASGYTFTNYYMHWVRQAPGQGLEWMGIINPSGGSTSYAQKFLGRVTMTRDTSTTTVYMELSSLRSEDTAVYFCARVENLPTKWDLLRKGFESGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 674 - DNA, 645 bp, synthetic construct
  misc_feature 1..645: note = Synthetic
  source 1..645: mol_type = other DNA
gaaatagtgatgacgcagtctccagccactgtgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccagcttcagtggcagtgggtctgggacagagttcactctcaccatcagcagcctgcagtctgaagattttgcagtttattactgtcagcagtataataactggccaatcactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 675 - protein, 214 aa, synthetic construct
  REGION 1..214: note = Synthetic
EIVMTQSPATVSVSPGERATLSCRASQSVSSNLAWYQQKPGQAPRLLIYGASTRATGIPASFSGSGSGTEFTLTISSLQSEDFAVYYCQQYNNWPITFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 676 - DNA, 384 bp, synthetic construct
  misc_feature 1..384: note = Synthetic
  source 1..384: mol_type = other DNA
cagctgcagctgcaggagtcgggcccaggactggtgaagccttcggagaccctgtccctcacctgcactgtctctggtggctccatcagcagtagtggtcactactggggctggatccgccagtccccagggaaggggctagactggattggcagtatctattatagtgggagcacctactacaacccgtccctcaagagtcgagtcaccatatcagtagacacgtccaagaaccagttctccctgaagctgaactctgtgaccgccgcggacacggccgtgtatttctgtgcgagacttgaggcctattgtagtggtgatacctgccactacttctacggtttggacgtctggggccaagggaccacggtcaccgtctcctca

SEQ ID NO: 677 - protein, 128 aa, synthetic construct
  REGION 1..128: note = Synthetic
QLQLQESGPGLVKPSETLSLTCTVSGGSISSSGHYWGWIRQSPGKGLDWIGSIYYSGSTYYNPSLKSRVTISVDTSKNQFSLKLNSVTAADTAVYFCARLEAYCSGDTCHYFYGLDVWGQGTTVTVSS

SEQ ID NO: 678 - DNA, 30 bp, synthetic construct
  misc_feature 1..30: note = Synthetic
  source 1..30: mol_type = other DNA
ggtggctccatcagcagtagtggtcactac

SEQ ID NO: 679 - protein, 10 aa, synthetic construct
  REGION 1..10: note = Synthetic
GGSISSSGHY

SEQ ID NO: 680 - DNA, 21 bp, synthetic construct
  misc_feature 1..21: note = Synthetic
  source 1..21: mol_type = other DNA
atctattatagtgggagcacc

SEQ ID NO: 681 - DNA, 60 bp, synthetic construct
  misc_feature 1..60: note = Synthetic
  source 1..60: mol_type = other DNA
gcgagacttgaggcctattgtagtggtgatacctgccactacttctacggtttggacgtc

SEQ ID NO: 682 - protein, 20 aa, synthetic construct
  REGION 1..20: note = Synthetic
ARLEAYCSGDTCHYFYGLDV

SEQ ID NO: 683 - DNA, 321 bp, synthetic construct
  misc_feature 1..321: note = Synthetic
  source 1..321: mol_type = other DNA
gacatccagatgacccagtctccatcctccctgtctgcatctgtaggagacagagtcaccatcacttgccgggcaagtcagagcattaacacctatttaaattggtatcagcagaaaccagggaaagcccctaacctcctgatcgatggtgcatccagtttgcaaagtggggtcccatcaaggttcagtggcagtggatctgggacagacttcattctcaccatcagcagtctgcgacctgaggattttgcaacttactactgtcaacagagttacagtattcctctcactttcggcggagggaccagggtggagatcaaa

SEQ ID NO: 684 - protein, 107 aa, synthetic construct
  REGION 1..107: note = Synthetic
DIQMTQSPSSLSASVGDRVTITCRASQSINTYLNWYQQKPGKAPNLLIDGASSLQSGVPSRFSGSGSGTDFILTISSLRPEDFATYYCQQSYSIPLTFGGGTRVEIK

SEQ ID NO: 685 - DNA, 18 bp, synthetic construct
  misc_feature 1..18: note = Synthetic
  source 1..18: mol_type = other DNA
cagagcattaacacctat

SEQ ID NO: 686 - protein, 6 aa, synthetic construct
  REGION 1..6: note = Synthetic
QSINTY

SEQ ID NO: 687 - DNA, 27 bp, synthetic construct
  misc_feature 1..27: note = Synthetic
  source 1..27: mol_type = other DNA
caacagagttacagtattcctctcact

SEQ ID NO: 688 - protein, 9 aa, synthetic construct
  REGION 1..9: note = Synthetic
QQSYSIPLT

SEQ ID NO: 689 - DNA, 1377 bp, synthetic construct
  misc_feature 1..1377: note = Synthetic
  source 1..1377: mol_type = other DNA
cagctgcagctgcaggagtcgggcccaggactggtgaagccttcggagaccctgtccctcacctgcactgtctctggtggctccatcagcagtagtggtcactactggggctggatccgccagtccccagggaaggggctagactggattggcagtatctattatagtgggagcacctactacaacccgtccctcaagagtcgagtcaccatatcagtagacacgtccaagaaccagttctccctgaagctgaactctgtgaccgccgcggacacggccgtgtatttctgtgcgagacttgaggcctattgtagtggtgatacctgccactacttctacggtttggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 690 - protein, 458 aa, synthetic construct
  REGION 1..458: note = Synthetic
QLQLQESGPGLVKPSETLSLTCTVSGGSISSSGHYWGWIRQSPGKGLDWIGSIYYSGSTYYNPSLKSRVTISVDTSKNQFSLKLNSVTAADTAVYFCARLEAYCSGDTCHYFYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 691 - DNA, 645 bp, synthetic construct
  misc_feature 1..645: note = Synthetic
  source 1..645: mol_type = other DNA
gacatccagatgacccagtctccatcctccctgtctgcatctgtaggagacagagtcaccatcacttgccgggcaagtcagagcattaacacctatttaaattggtatcagcagaaaccagggaaagcccctaacctcctgatcgatggtgcatccagtttgcaaagtggggtcccatcaaggttcagtggcagtggatctgggacagacttcattctcaccatcagcagtctgcgacctgaggattttgcaacttactactgtcaacagagttacagtattcctctcactttcggcggagggaccagggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 692 - protein, 214 aa, synthetic construct
  REGION 1..214: note = Synthetic
DIQMTQSPSSLSASVGDRVTITCRASQSINTYLNWYQQKPGKAPNLLIDGASSLQSGVPSRFSGSGSGTDFILTISSLRPEDFATYYCQQSYSIPLTFGGGTRVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 693 - DNA, 351 bp, synthetic construct
  misc_feature 1..351: note = Synthetic
  source 1..351: mol_type = other DNA
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatataggtataactacgccctactggggccagggaaccctggtcaccgtctcctca

SEQ ID NO: 694 - protein, 117 aa, synthetic construct
  REGION 1..117: note = Synthetic
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDIGITTPYWGQGTLVTVSS

SEQ ID NO: 695 - DNA, 24 bp, synthetic construct
  misc_feature 1..24: note = Synthetic
  source 1..24: mol_type = other DNA
ggattcacctttgatgattatgcc

SEQ ID NO: 696 - protein, 8 aa, synthetic construct
  REGION 1..8: note = Synthetic
GFTFDDYA

SEQ ID NO: 697 - DNA, 24 bp, synthetic construct
  misc_feature 1..24: note = Synthetic
  source 1..24: mol_type = other DNA
attagttggaatagtggtagcata

SEQ ID NO: 698 - protein, 8 aa, synthetic construct
  REGION 1..8: note = Synthetic
ISWNSGSI

SEQ ID NO: 699 - DNA, 30 bp, synthetic construct
  misc_feature 1..30: note = Synthetic
  source 1..30: mol_type = other DNA
gcaaaagatataggtataactacgccctac

SEQ ID NO: 700 - protein, 10 aa, synthetic construct
  REGION 1..10: note = Synthetic
AKDIGITTPY

SEQ ID NO: 701 - DNA, 321 bp, synthetic construct
  misc_feature 1..321: note = Synthetic
  source 1..321: mol_type = other DNA
gccatccagatgacccagtctccatcctccctgtctgcatctgtaggagacagagtcaccatcacttgccgggcaagtcaggacattagaaatgatttaggctggtatcagcagaaaccagggaaagcccctaagctcctgatctattctgcatccagtttacaaactggggtcccatcaaggttcagcggcagtggatctggcaccgatttcactctcaccatcagcagcctgcaccctgaagattttgcaacttattactgtctacaagattacaattacgtgtggacgttcggccaagggaccaaggtggaaatcaaa

SEQ ID NO: 702 - protein, 107 aa, synthetic construct
  REGION 1..107: note = Synthetic
AIQMTQSPSSLSASVGDRVTITCRASQDIRNDLGWYQQKPGKAPKLLIYSASSLQTGVPSRFSGSGSGTDFTLTISSLHPEDFATYYCLQDYNYVWTFGQGTKVEIK

SEQ ID NO: 703 - DNA, 18 bp, synthetic construct
  misc_feature 1..18: note = Synthetic
  source 1..18: mol_type = other DNA
caggacattagaaatgat

SEQ ID NO: 704 - protein, 6 aa, synthetic construct
  REGION 1..6: note = Synthetic
QDIRND

SEQ ID NO: 705-706 - skipped (2 entries)

SEQ ID NO: 707 - DNA, 27 bp, synthetic construct
  misc_feature 1..27: note = Synthetic
  source 1..27: mol_type = other DNA
ctacaagattacaattacgtgtggacg

SEQ ID NO: 708 - protein, 9 aa, synthetic construct
  REGION 1..9: note = Synthetic
LQDYNYVWT

SEQ ID NO: 709 - DNA, 1344 bp, synthetic construct
  misc_feature 1..1344: note = Synthetic
  source 1..1344: mol_type = other DNA
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatataggtataactacgccctactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 710 - protein, 447 aa, synthetic construct
  REGION 1..447: note = Synthetic
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDIGITTPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 711 - DNA, 645 bp, synthetic construct
  misc_feature 1..645: note = Synthetic
  source 1..645: mol_type = other DNA
gccatccagatgacccagtctccatcctccctgtctgcatctgtaggagacagagtcaccatcacttgccgggcaagtcaggacattagaaatgatttaggctggtatcagcagaaaccagggaaagcccctaagctcctgatctattctgcatccagtttacaaactggggtcccatcaaggttcagcggcagtggatctggcaccgatttcactctcaccatcagcagcctgcaccctgaagattttgcaacttattactgtctacaagattacaattacgtgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 712 - protein, 214 aa, synthetic construct
  REGION 1..214: note = Synthetic
AIQMTQSPSSLSASVGDRVTITCRASQDIRNDLGWYQQKPGKAPKLLIYSASSLQTGVPSRFSGSGSGTDFTLTISSLHPEDFATYYCLQDYNYVWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 713 - DNA, 372 bp, synthetic construct
  misc_feature 1..372: note = Synthetic
  source 1..372: mol_type = other DNA
gaagtgcagctggtggagtctgggggaggcttgatacagcctggcaggtccctgagactctcctgtgcagcctctggattcacctttgatgattatgccatgcactgggtccggcaagctccagggaagggcctggagtgggtctcaggtattagttggaatagtgttagcatagactatgcggactctgtgaagggccgattcaccatctccagagacaacgccaagaactccctgtatctccaaatgaccagtctgacagttgaggacacggccttgtattactgtgcaaaagctttcggatacgagactttgactggctctgactactttgcctactggggcccgggaaccctggtcaccgtctcctca

SEQ ID NO: 714 - protein, 124 aa, synthetic construct
  REGION 1..124: note = Synthetic
EVQLVESGGGLIQPGRSLRLSCAASGFTFDDYAMHWVRQAPGKGLEWVSGISWNSVSIDYADSVKGRFTISRDNAKNSLYLQMTSLTVEDTALYYCAKAFGYETLTGSDYFAYWGPGTLVTVSS

SEQ ID NO: 715 - DNA, 24 bp, synthetic construct
  misc_feature 1..24: note = Synthetic
  source 1..24: mol_type = other DNA
attagttggaatagtgttagcata

SEQ ID NO: 716 - protein, 8 aa, synthetic construct
  REGION 1..8: note = Synthetic
ISWNSVSI

SEQ ID NO: 717 - DNA, 51 bp, synthetic construct
  misc_feature 1..51: note = Synthetic
  source 1..51: mol_type = other DNA
gcaaaagctttcggatacgagactttgactggctctgactactttgcctac

SEQ ID NO: 718 - protein, 17 aa, synthetic construct
  REGION 1..17: note = Synthetic
AKAFGYETLTGSDYFAY

SEQ ID NO: 719 - DNA, 327 bp, synthetic construct
  misc_feature 1..327: note = Synthetic
  source 1..327: mol_type = other DNA
gaaattgtgttgacgcagtctccaggcaccctgtctttgtctccaggggaaagggccaccctctcctgcagggccagtcagactgttatcagcacctacttagcctggtaccagcagaaacctggccagtctcccaggctcctcatctatggtgcatccagcagggccactggcatcccagacaggttcagtggtagtgggtctgggacagacttcactctcaccatcagcagactggagcctgaagattttgcagtgtattactgtcagcagtatggtagctcacctcagttgactttcggcggagggaccaaggtggagatcaaa

SEQ ID NO: 720 - protein, 109 aa, synthetic construct
  REGION 1..109: note = Synthetic
EIVLTQSPGTLSLSPGERATLSCRASQTVISTYLAWYQQKPGQSPRLLIYGASSRATGIPDRFSGSGSGTDFTLTISRLEPEDFAVYYCQQYGSSPQLTFGGGTKVEIK

SEQ ID NO: 721 - DNA, 21 bp, synthetic construct
  misc_feature 1..21: note = Synthetic
  source 1..21: mol_type = other DNA
cagactgttatcagcacctac

SEQ ID NO: 722 - protein, 7 aa, synthetic construct
  REGION 1..7: note = Synthetic
QTVISTY

SEQ ID NO: 723 - DNA, 30 bp, synthetic construct
  misc_feature 1..30: note = Synthetic
  source 1..30: mol_type = other DNA
cagcagtatggtagctcacctcagttgact

SEQ ID NO: 724 - protein, 10 aa, synthetic construct
  REGION 1..10: note = Synthetic
QQYGSSPQLT

SEQ ID NO: 725 - DNA, 1365 bp, synthetic construct
  misc_feature 1..1365: note = Synthetic
  source 1..1365: mol_type = other DNA
gaagtgcagctggtggagtctgggggaggcttgatacagcctggcaggtccctgagactctcctgtgcagcctctggattcacctttgatgattatgccatgcactgggtccggcaagctccagggaagggcctggagtgggtctcaggtattagttggaatagtgttagcatagactatgcggactctgtgaagggccgattcaccatctccagagacaacgccaagaactccctgtatctccaaatgaccagtctgacagttgaggacacggccttgtattactgtgcaaaagctttcggatacgagactttgactggctctgactactttgcctactggggcccgggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 726 - protein, 454 aa, synthetic construct
  REGION 1..454: note = Synthetic
EVQLVESGGGLIQPGRSLRLSCAASGFTFDDYAMHWVRQAPGKGLEWVSGISWNSVSIDYADSVKGRFTISRDNAKNSLYLQMTSLTVEDTALYYCAKAFGYETLTGSDYFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 727 - DNA, 651 bp, synthetic construct
  misc_feature 1..651: note = Synthetic
  source 1..651: mol_type = other DNA
gaaattgtgttgacgcagtctccaggcaccctgtctttgtctccaggggaaagggccaccctctcctgcagggccagtcagactgttatcagcacctacttagcctggtaccagcagaaacctggccagtctcccaggctcctcatctatggtgcatccagcagggccactggcatcccagacaggttcagtggtagtgggtctgggacagacttcactctcaccatcagcagactggagcctgaagattttgcagtgtattactgtcagcagtatggtagctcacctcagttgactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 728 - protein, 216 aa, synthetic construct
  REGION 1..216: note = Synthetic
EIVLTQSPGTLSLSPGERATLSCRASQTVISTYLAWYQQKPGQSPRLLIYGASSRATGIPDRFSGSGSGTDFTLTISRLEPEDFAVYYCQQYGSSPQLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 729 - DNA, 384 bp, synthetic construct
  misc_feature 1..384: note = Synthetic
  source 1..384: mol_type = other DNA
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagggccccggggaattttgactggttattccgcagtgactactactacggtatggacgtctggggccaagggaccacggtcaccgtctcctca

SEQ ID NO: 730 - protein, 128 aa, synthetic construct
  REGION 1..128: note = Synthetic
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARAPGNFDWLFRSDYYYGMDVWGQGTTVTVSS

SEQ ID NO: 731 - DNA, 24 bp, synthetic construct
  misc_feature 1..24: note = Synthetic
  source 1..24: mol_type = other DNA
ggattcacctttagtagctattgg

SEQ ID NO: 732 - protein, 8 aa, synthetic construct
  REGION 1..8: note = Synthetic
GFTFSSYW

SEQ ID NO: 733 - DNA, 24 bp, synthetic construct
  misc_feature 1..24: note = Synthetic
  source 1..24: mol_type = other DNA
ataaagcaagatggaagtgagaaa

SEQ ID NO: 734 - protein, 8 aa, synthetic construct
  REGION 1..8: note = Synthetic
IKQDGSEK

SEQ ID NO: 735 - DNA, 63 bp, synthetic construct
  misc_feature 1..63: note = Synthetic
  source 1..63: mol_type = other DNA
gcgagggccccggggaattttgactggttattccgcagtgactactactacggtatggacgtc

SEQ ID NO: 736 - protein, 21 aa, synthetic construct
  REGION 1..21: note = Synthetic
ARAPGNFDWLFRSDYYYGMDV

SEQ ID NO: 737 - DNA, 321 bp, synthetic construct
  misc_feature 1..321: note = Synthetic
  source 1..321: mol_type = other DNA
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccgtcaccttcggccaagggacacgactggagattaaa

SEQ ID NO: 738 - protein, 107 aa, synthetic construct
  REGION 1..107: note = Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPVTFGQGTRLEIK

SEQ ID NO: 739 - DNA, 18 bp, synthetic construct
  misc_feature 1..18: note = Synthetic
  source 1..18: mol_type = other DNA
cagagcattagcagctat

SEQ ID NO: 740 - protein, 6 aa, synthetic construct
  REGION 1..6: note = Synthetic
QSISSY

SEQ ID NO: 741 - DNA, 27 bp, synthetic construct
  misc_feature 1..27: note = Synthetic
  source 1..27: mol_type = other DNA
caacagagttacagtacccccgtcacc

SEQ ID NO: 742 - protein, 9 aa, synthetic construct
  REGION 1..9: note = Synthetic
QQSYSTPVT

SEQ ID NO: 743 - DNA, 1377 bp, synthetic construct
  misc_feature 1..1377: note = Synthetic
  source 1..1377: mol_type = other DNA
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagggccccggggaattttgactggttattccgcagtgactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 744 - protein, 458 aa, synthetic construct
  REGION 1..458: note = Synthetic
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARAPGNFDWLFRSDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 745 - DNA, 645 bp, synthetic construct
  misc_feature 1..645: note = Synthetic
  source 1..645: mol_type = other DNA
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccgtcaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 746 - protein, 214 aa, synthetic construct
  REGION 1..214: note = Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPVTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 747 - DNA, 357 bp, synthetic construct
  misc_feature 1..357: note = Synthetic
  source 1..357: mol_type = other DNA
cagatcaccttgaaggagtctggtcctacgctggtgaaacccacacagaccctcacgctgacctgcaccttctctgggttctcactcagcgccagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacaacataaagtggctacgatttttgactattggggccagggaaccctggtcaccgtctcctca

SEQ ID NO: 748 - protein, 119 aa, synthetic construct
  REGION 1..119: note = Synthetic
QITLKESGPTLVKPTQTLTLTCTFSGFSLSASGVGVGWIRQPPGKALEWLALIYWDDDKRYSPSLKSRLTITKDTSKNQVVLTMTNMDPVDTATYYCAQHKVATIFDYWGQGTLVTVSS

SEQ ID NO: 749 - DNA, 30 bp, synthetic construct
  misc_feature 1..30: note = Synthetic
  source 1..30: mol_type = other DNA
gggttctcactcagcgccagtggagtgggt

SEQ ID NO: 750 - protein, 10 aa, synthetic construct
  REGION 1..10: note = Synthetic
GFSLSASGVG

SEQ ID NO: 751 - DNA, 33 bp, synthetic construct
  misc_feature 1..33: note = Synthetic
  source 1..33: mol_type = other DNA
gcacaacataaagtggctacgatttttgactat

SEQ ID NO: 752 - protein, 11 aa, synthetic construct
  REGION 1..11: note = Synthetic
AQHKVATIFDY

SEQ ID NO: 753 - DNA, 327 bp, synthetic construct
  misc_feature 1..327: note = Synthetic
  source 1..327: mol_type = other DNA
cagtctgccctgactcagcctccctccgcgtccgggtctcctggacagtcagtcaccatctcctgcactgcaaccagcagtgacgttggtaattataactatgtctcctggtaccaacagcacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatgcaggcagttggggggtattcggcggagggaccaagctgaccgtccta

SEQ ID NO: 754 - protein, 109 aa, synthetic construct
  REGION 1..109: note = Synthetic
QSALTQPPSASGSPGQSVTISCTATSSDVGNYNYVSWYQQHPGKAPKLMIYEVTKRPSGVPDRFSGSKSGNTASLTVSGLQAEDEADYYCSSYAGSWGVFGGGTKLTVL

SEQ ID NO: 755 - DNA, 27 bp, synthetic construct
  misc_feature 1..27: note = Synthetic
  source 1..27: mol_type = other DNA
agcagtgacgttggtaattataactat

SEQ ID NO: 756 - protein, 9 aa, synthetic construct
  REGION 1..9: note = Synthetic
SSDVGNYNY

SEQ ID NO: 757 - DNA, 27 bp, synthetic construct
  misc_feature 1..27: note = Synthetic
  source 1..27: mol_type = other DNA
agctcatatgcaggcagttggggggta

SEQ ID NO: 758 - protein, 9 aa, synthetic construct
  REGION 1..9: note = Synthetic
SSYAGSWGV

SEQ ID NO: 759 - DNA, 1350 bp, synthetic construct
  misc_feature 1..1350: note = Synthetic
  source 1..1350: mol_type = other DNA
cagatcaccttgaaggagtctggtcctacgctggtgaaacccacacagaccctcacgctgacctgcaccttctctgggttctcactcagcgccagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacaacataaagtggctacgatttttgactattggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 760 - protein, 449 aa, synthetic construct
  REGION 1..449: note = Synthetic
QITLKESGPTLVKPTQTLTLTCTFSGFSLSASGVGVGWIRQPPGKALEWLALIYWDDDKRYSPSLKSRLTITKDTSKNQVVLTMTNMDPVDTATYYCAQHKVATIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 761 - DNA, 648 bp, synthetic construct
  misc_feature 1..648: note = Synthetic
  source 1..648: mol_type = other DNA
cagtctgccctgactcagcctccctccgcgtccgggtctcctggacagtcagtcaccatctcctgcactgcaaccagcagtgacgttggtaattataactatgtctcctggtaccaacagcacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatgcaggcagttggggggtattcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 762 - protein, 215 aa, synthetic construct
  REGION 1..215: note = Synthetic
QSALTQPPSASGSPGQSVTISCTATSSDVGNYNYVSWYQQHPGKAPKLMIYEVTKRPSGVPDRFSGSKSGNTASLTVSGLQAEDEADYYCSSYAGSWGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 763 - DNA, 357 bp, synthetic construct
  misc_feature 1..357: note = Synthetic
  source 1..357: mol_type = other DNA
caggtgcagctggtggagtctgggggaggcgtggtccagcctgggaggtccctgagactctcctgtgcagcctctggattcatcttcagtagctatggcatgcactgggtccgccaggctccaggcaaggggctggagtgggtggcagttatatggtatgatggaagtaataaattctatgcagactccgtgaagggccgattcaccatttccagagacaattccaagaacacgctgtatctgcaagtgaacagcctgagagccgaggacacggctgtgtattactgtgcgagagctgtacagggggactggtactttgaccactggggccagggaaccctggtcaccgtctcctca

SEQ ID NO: 764 - protein, 119 aa, synthetic construct
  REGION 1..119: note = Synthetic
QVQLVESGGGVVQPGRSLRLSCAASGFIFSSYGMHWVRQAPGKGLEWVAVIWYDGSNKFYADSVKGRFTISRDNSKNTLYLQVNSLRAEDTAVYYCARAVQGDWYFDHWGQGTLVTVSS

SEQ ID NO: 765 - DNA, 24 bp, synthetic construct
  misc_feature 1..24: note = Synthetic
  source 1..24: mol_type = other DNA
ggattcatcttcagtagctatggc

SEQ ID NO: 766 - protein, 8 aa, synthetic construct
  REGION 1..8: note = Synthetic
GFIFSSYG

SEQ ID NO: 767 - DNA, 24 bp, synthetic construct
  misc_feature 1..24: note = Synthetic
  source 1..24: mol_type = other DNA
atatggtatgatggaagtaataaa

SEQ ID NO: 768 - protein, 8 aa, synthetic construct
  REGION 1..8: note = Synthetic
IWYDGSNK

SEQ ID NO: 769 - DNA, 36 bp, synthetic construct
  misc_feature 1..36: note = Synthetic
  source 1..36: mol_type = other DNA
gcgagagctgtacagggggactggtactttgaccac

SEQ ID NO: 770 - protein, 12 aa, synthetic construct
  REGION 1..12: note = Synthetic
ARAVQGDWYFDH

SEQ ID NO: 771 - DNA, 324 bp, synthetic construct
  misc_feature 1..324: note = Synthetic
  source 1..324: mol_type = other DNA
tcctatgagctgacacagccaccctcggtgtcagtgtccccaggacagacggccaggatcacctgctctggagatgtattggcaaagctgtatgcctattggtaccagcacaagccaggccaggcccctgtgttggtgatatataaagacagtgagaggccctcagggatccctgagcgattctctggctccagctcagggacaacagtcacgttgaccatcagtggagtccaggcagaagacgaggctgactattactgtcaatcagcagacagcagtggcagtctttgggtgttcggcggagggaccaagctgaccgtccta

SEQ ID NO: 772 - protein, 108 aa, synthetic construct
  REGION 1..108: note = Synthetic
SYELTQPPSVSVSPGQTARITCSGDVLAKLYAYWYQHKPGQAPVLVIYKDSERPSGIPERFSGSSSGTTVTLTISGVQAEDEADYYCQSADSSGSLWVFGGGTKLTVL

SEQ ID NO: 773 - DNA, 18 bp, synthetic construct
  misc_feature 1..18: note = Synthetic
  source 1..18: mol_type = other DNA
gtattggcaaagctgtat

SEQ ID NO: 774 - protein, 6 aa, synthetic construct
  REGION 1..6: note = Synthetic
VLAKLY

SEQ ID NO: 775-776 - skipped (2 entries)

SEQ ID NO: 777 - DNA, 33 bp, synthetic construct
  misc_feature 1..33: note = Synthetic
  source 1..33: mol_type = other DNA
caatcagcagacagcagtggcagtctttgggtg

SEQ ID NO: 778 - protein, 11 aa, synthetic construct
  REGION 1..11: note = Synthetic
QSADSSGSLWV

SEQ ID NO: 779 - DNA, 1350 bp, synthetic construct
  misc_feature 1..1350: note = Synthetic
  source 1..1350: mol_type = other DNA
caggtgcagctggtggagtctgggggaggcgtggtccagcctgggaggtccctgagactctcctgtgcagcctctggattcatcttcagtagctatggcatgcactgggtccgccaggctccaggcaaggggctggagtgggtggcagttatatggtatgatggaagtaataaattctatgcagactccgtgaagggccgattcaccatttccagagacaattccaagaacacgctgtatctgcaagtgaacagcctgagagccgaggacacggctgtgtattactgtgcgagagctgtacagggggactggtactttgaccactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 780 - protein, 449 aa, synthetic construct
  REGION 1..449: note = Synthetic
QVQLVESGGGVVQPGRSLRLSCAASGFIFSSYGMHWVRQAPGKGLEWVAVIWYDGSNKFYADSVKGRFTISRDNSKNTLYLQVNSLRAEDTAVYYCARAVQGDWYFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 781 - DNA, 645 bp, synthetic construct
  misc_feature 1..645: note = Synthetic
  source 1..645: mol_type = other DNA
tcctatgagctgacacagccaccctcggtgtcagtgtccccaggacagacggccaggatcacctgctctggagatgtattggcaaagctgtatgcctattggtaccagcacaagccaggccaggcccctgtgttggtgatatataaagacagtgagaggccctcagggatccctgagcgattctctggctccagctcagggacaacagtcacgttgaccatcagtggagtccaggcagaagacgaggctgactattactgtcaatcagcagacagcagtggcagtctttgggtgttcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 782 - protein, 214 aa, synthetic construct
  REGION 1..214: note = Synthetic
SYELTQPPSVSVSPGQTARITCSGDVLAKLYAYWYQHKPGQAPVLVIYKDSERPSGIPERFSGSSSGTTVTLTISGVQAEDEADYYCQSADSSGSLWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 783 - DNA, 381 bp, synthetic construct
  misc_feature 1..381: note = Synthetic
  source 1..381: mol_type = other DNA
caggtgcagctggtggagtctgggggaggcgtggtccagcctgggaggtccctgagactctcctgtgcagcctctggattcaccttcagtagctatggcattcactgggtccgccaggctccaggcaaggggctggagtgggtggcaattatctggtatgatggaagtgagaaatattatgcagactccgtgaagggccgattcaccatctccagagacaattccaagaacacgctgtttctgcaaatgaacagcctggaggccgaggacacggctgtctattactgtgcgagaggccccgatcttttgactggttactataactacttctactacggtatggacgtctggggccaagggaccacggtcaccgtctcctca

SEQ ID NO: 784 - protein, 127 aa, synthetic construct
  REGION 1..127: note = Synthetic
QVQLVESGGGVVQPGRSLRLSCAASGFTFSSYGIHWVRQAPGKGLEWVAIIWYDGSEKYYADSVKGRFTISRDNSKNTLFLQMNSLEAEDTAVYYCARGPDLLTGYYNYFYYGMDVWGQGTTVTVSS

SEQ ID NO: 785 - DNA, 24 bp, synthetic construct
  misc_feature 1..24: note = Synthetic
  source 1..24: mol_type = other DNA
ggattcaccttcagtagctatggc

SEQ ID NO: 786 - protein, 8 aa, synthetic construct
  REGION 1..8: note = Synthetic
GFTFSSYG

SEQ ID NO: 787 - DNA, 24 bp, synthetic construct
  misc_feature 1..24: note = Synthetic
  source 1..24: mol_type = other DNA
atctggtatgatggaagtgagaaa

SEQ ID NO: 788 - protein, 8 aa, synthetic construct
  REGION 1..8: note = Synthetic
IWYDGSEK

SEQ ID NO: 789 - DNA, 60 bp, synthetic construct
  misc_feature 1..60: note = Synthetic
  source 1..60: mol_type = other DNA
gcgagaggccccgatcttttgactggttactataactacttctactacggtatggacgtc

SEQ ID NO: 790 - protein, 20 aa, synthetic construct
  REGION 1..20: note = Synthetic
ARGPDLLTGYYNYFYYGMDV

SEQ ID NO: 791 - DNA, 333 bp, synthetic construct
  misc_feature 1..333: note = Synthetic
  source 1..333: mol_type = other DNA
cagtctgtgctgacgcagccgccctcagtgtctggggccccagggcagagggtcaccatctcctgcactgggagcagctccaacatcgggataggttatgatgtacactggtaccagcagcttccaggaacagtccccaaactcctcatctatggtaacaccaatcggccctcaggggtccctgaccgattctctggctccaagtctggcacctcagcctccctggccatcactgggctccaggctgaggatgaggctgattattactgccagtcctatgacagctccctgagtagttatgtcttcggaactgggaccaaggtcaccgtccta

SEQ ID NO: 792 - protein, 111 aa, synthetic construct
  REGION 1..111: note = Synthetic
QSVLTQPPSVSGAPGQRVTISCTGSSSNIGIGYDVHWYQQLPGTVPKLLIYGNTNRPSGVPDRFSGSKSGTSASLAITGLQAEDEADYYCQSYDSSLSSYVFGTGTKVTVL

SEQ ID NO: 793 - DNA, 27 bp, synthetic construct
  misc_feature 1..27: note = Synthetic
  source 1..27: mol_type = other DNA
agctccaacatcgggataggttatgat

SEQ ID NO: 794 - protein, 9 aa, synthetic construct
  REGION 1..9: note = Synthetic
SSNIGIGYD

SEQ ID NO: 795-796 - skipped (2 entries)

SEQ ID NO: 797 - DNA, 33 bp, synthetic construct
  misc_feature 1..33: note = Synthetic
  source 1..33: mol_type = other DNA
cagtcctatgacagctccctgagtagttatgtc

SEQ ID NO: 798 - protein, 11 aa, synthetic construct
  REGION 1..11: note = Synthetic
QSYDSSLSSYV

SEQ ID NO: 799 - DNA, 1374 bp, synthetic construct
  misc_feature 1..1374: note = Synthetic
  source 1..1374: mol_type = other DNA
caggtgcagctggtggagtctgggggaggcgtggtccagcctgggaggtccctgagactctcctgtgcagcctctggattcaccttcagtagctatggcattcactgggtccgccaggctccaggcaaggggctggagtgggtggcaattatctggtatgatggaagtgagaaatattatgcagactccgtgaagggccgattcaccatctccagagacaattccaagaacacgctgtttctgcaaatgaacagcctggaggccgaggacacggctgtctattactgtgcgagaggccccgatcttttgactggttactataactacttctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 800 - protein, 457 aa, synthetic construct
  REGION 1..457: note = Synthetic
QVQLVESGGGVVQPGRSLRLSCAASGFTFSSYGIHWVRQAPGKGLEWVAIIWYDGSEKYYADSVKGRFTISRDNSKNTLFLQMNSLEAEDTAVYYCARGPDLLTGYYNYFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 801 - DNA, 654 bp, synthetic construct
  misc_feature 1..654: note = Synthetic
  source 1..654: mol_type = other DNA
cagtctgtgctgacgcagccgccctcagtgtctggggccccagggcagagggtcaccatctcctgcactgggagcagctccaacatcgggataggttatgatgtacactggtaccagcagcttccaggaacagtccccaaactcctcatctatggtaacaccaatcggccctcaggggtccctgaccgattctctggctccaagtctggcacctcagcctccctggccatcactgggctccaggctgaggatgaggctgattattactgccagtcctatgacagctccctgagtagttatgtcttcggaactgggaccaaggtcaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 802 - protein, 217 aa, synthetic construct
  REGION 1..217: note = Synthetic
QSVLTQPPSVSGAPGQRVTISCTGSSSNIGIGYDVHWYQQLPGTVPKLLIYGNTNRPSGVPDRFSGSKSGTSASLAITGLQAEDEADYYCQSYDSSLSSYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 803 - DNA, 357 bp, synthetic construct
  misc_feature 1..357: note = Synthetic
  source 1..357: mol_type = other DNA
cagatcaccttgaaggagtctggtcctacgctggtgaaacccacacagaccctcacgctgacctgcaccttctctgggttctcactcaacactggtggagtgggtgtgggctggatccgtcagcccccaggaaatgccctggagtggcttgcactcatttattgggatgatgataagcgctacaacccatctctgaagaccaggctcaccatcagcaaggacacctccaaaaatcaggtggtccttacaatgaccaacatggaccctgtggacacagccacatatttctgtgcacatcttactatagcagtgattgttgacttctggggccagggaaccctggtcaccgtctcctca

SEQ ID NO: 804 - protein, 119 aa, synthetic construct
  REGION 1..119: note = Synthetic
QITLKESGPTLVKPTQTLTLTCTFSGFSLNTGGVGVGWIRQPPGNALEWLALIYWDDDKRYNPSLKTRLTISKDTSKNQVVLTMTNMDPVDTATYFCAHLTIAVIVDFWGQGTLVTVSS

SEQ ID NO: 805 - DNA, 30 bp, synthetic construct
  misc_feature 1..30: note = Synthetic
  source 1..30: mol_type = other DNA
gggttctcactcaacactggtggagtgggt

SEQ ID NO: 806 - protein, 10 aa, synthetic construct
  REGION 1..10: note = Synthetic
GFSLNTGGVG

SEQ ID NO: 807 - DNA, 33 bp, synthetic construct
  misc_feature 1..33: note = Synthetic
  source 1..33: mol_type = other DNA
gcacatcttactatagcagtgattgttgacttc

SEQ ID NO: 808 - protein, 11 aa, synthetic construct
  REGION 1..11: note = Synthetic
AHLTIAVIVDF

SEQ ID NO: 809 - DNA, 327 bp, synthetic construct
  misc_feature 1..327: note = Synthetic
  source 1..327: mol_type = other DNA
cagtctgccctgactcagcctgcctccgtgtctgggtctcctggacagtcgatcaccatctcctgcactgcaaccagcagtgacgttggtacttataactatgtctcctggttccaacaccacccaggcaaagcccccaaactcatgatttatgaggtcactaatcggccctcaggggtttctaatcgcttctctggctccaagtctggcaacacggcctccctgaccatctctgggctccaggctgaggacgaggctgattattactgcagctcatatacgaccaccagcattgtattcggcggagggaccaagctgaccgtccta

SEQ ID NO: 810 - protein, 109 aa, synthetic construct
  REGION 1..109: note = Synthetic
QSALTQPASVSGSPGQSITISCTATSSDVGTYNYVSWFQHHPGKAPKLMIYEVTNRPSGVSNRFSGSKSGNTASLTISGLQAEDEADYYCSSYTTTSIVFGGGTKLTVL

SEQ ID NO: 811 - DNA, 27 bp, synthetic construct
  misc_feature 1..27: note = Synthetic
  source 1..27: mol_type = other DNA
agcagtgacgttggtacttataactat

SEQ ID NO: 812 - protein, 9 aa, synthetic construct
  REGION 1..9: note = Synthetic
SSDVGTYNY

SEQ ID NO: 813 - DNA, 27 bp, synthetic construct
  misc_feature 1..27: note = Synthetic
  source 1..27: mol_type = other DNA
agctcatatacgaccaccagcattgta

SEQ ID NO: 814 - protein, 9 aa, synthetic construct
  REGION 1..9: note = Synthetic
SSYTTTSIV

SEQ ID NO: 815 - DNA, 1350 bp, synthetic construct
  misc_feature 1..1350: note = Synthetic
  source 1..1350: mol_type = other DNA
cagatcaccttgaaggagtctggtcctacgctggtgaaacccacacagaccctcacgctgacctgcaccttctctgggttctcactcaacactggtggagtgggtgtgggctggatccgtcagcccccaggaaatgccctggagtggcttgcactcatttattgggatgatgataagcgctacaacccatctctgaagaccaggctcaccatcagcaaggacacctccaaaaatcaggtggtccttacaatgaccaacatggaccctgtggacacagccacatatttctgtgcacatcttactatagcagtgattgttgacttctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 816 - protein, 449 aa, synthetic construct
  REGION 1..449: note = Synthetic
QITLKESGPTLVKPTQTLTLTCTFSGFSLNTGGVGVGWIRQPPGNALEWLALIYWDDDKRYNPSLKTRLTISKDTSKNQVVLTMTNMDPVDTATYFCAHLTIAVIVDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 817 - DNA, 648 bp, synthetic construct
  misc_feature 1..648: note = Synthetic
  source 1..648: mol_type = other DNA
cagtctgccctgactcagcctgcctccgtgtctgggtctcctggacagtcgatcaccatctcctgcactgcaaccagcagtgacgttggtacttataactatgtctcctggttccaacaccacccaggcaaagcccccaaactcatgatttatgaggtcactaatcggccctcaggggtttctaatcgcttctctggctccaagtctggcaacacggcctccctgaccatctctgggctccaggctgaggacgaggctgattattactgcagctcatatacgaccaccagcattgtattcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 818 - protein, 215 aa, synthetic construct
  REGION 1..215: note = Synthetic
QSALTQPASVSGSPGQSITISCTATSSDVGTYNYVSWFQHHPGKAPKLMIYEVTNRPSGVSNRFSGSKSGNTASLTISGLQAEDEADYYCSSYTTTSIVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 819 - DNA, 357 bp, synthetic construct
  misc_feature 1..357: note = Synthetic
  source 1..357: mol_type = other DNA
cagatcaccttgaaggagtctggtcctacgctggtgaaacccacacagaccctcacgctgacctgcaccttctctgggttctcgctcagcactagtgcagtgggtgtgggctggatccggcagcccccaggaaaggccctggagtggcttgcactcatctattgggatgatgataagcgctacagcccatctctgaagagcaggctcaccatcaccaaggacacctccaaaaaccagctggtccttacaatgaccaacgtggaccctgtggacacagccacatattactgtgcacaccacacgatacaactaatctttgactactggggccagggaaccctggtcaccgtctcctca

SEQ ID NO: 820 - protein, 119 aa, synthetic construct
  REGION 1..119: note = Synthetic
QITLKESGPTLVKPTQTLTLTCTFSGFSLSTSAVGVGWIRQPPGKALEWLALIYWDDDKRYSPSLKSRLTITKDTSKNQLVLTMTNVDPVDTATYYCAHHTIQLIFDYWGQGTLVTVSS

SEQ ID NO: 821 - DNA, 30 bp, synthetic construct
  misc_feature 1..30: note = Synthetic
  source 1..30: mol_type = other DNA
gggttctcgctcagcactagtgcagtgggt

SEQ ID NO: 822 - protein, 10 aa, synthetic construct
  REGION 1..10: note = Synthetic
GFSLSTSAVG

SEQ ID NO: 823 - DNA, 21 bp, synthetic construct
  misc_feature 1..21: note = Synthetic
  source 1..21: mol_type = other DNA
atctattgggatgatgataag

SEQ ID NO: 824 - DNA, 33 bp, synthetic construct
  misc_feature 1..33: note = Synthetic
  source 1..33: mol_type = other DNA
gcacaccacacgatacaactaatctttgactac

SEQ ID NO: 825 - protein, 11 aa, synthetic construct
  REGION 1..11: note = Synthetic
AHHTIQLIFDY

SEQ ID NO: 826 - DNA, 333 bp, synthetic construct
  misc_feature 1..333: note = Synthetic
  source 1..333: mol_type = other DNA
cagtctgccctgactcagcctgcctccgtgtctgggtctcctggacagtcgatcaccatctcctgcactgcaaccagcagtgacgttggtaattataactatgtctcctggtaccaacagcacccaggcaaagcccccaaactcatgatttatgaggtcagtaatcggccctcaggggtttctaatcggttctctggctccaagtctggcaacacggcctccctgaccatctctgggctccaggctgaggacgaggctgattattactgcagctcatatacaagcagcagcacccctttggtattcggcggagggaccaagctgaccgtccta

SEQ ID NO: 827 - protein, 111 aa, synthetic construct
  REGION 1..111: note = Synthetic
QSALTQPASVSGSPGQSITISCTATSSDVGNYNYVSWYQQHPGKAPKLMIYEVSNRPSGVSNRFSGSKSGNTASLTISGLQAEDEADYYCSSYTSSSTPLVFGGGTKLTVL

SEQ ID NO: 828 - DNA, 33 bp, synthetic construct
  misc_feature 1..33: note = Synthetic
  source 1..33: mol_type = other DNA
agctcatatacaagcagcagcacccctttggta

SEQ ID NO: 829 - protein, 11 aa, synthetic construct
  REGION 1..11: note = Synthetic
SSYTSSSTPLV

SEQ ID NO: 830 - DNA, 1350 bp, synthetic construct
  misc_feature 1..1350: note = Synthetic
  source 1..1350: mol_type = other DNA
cagatcaccttgaaggagtctggtcctacgctggtgaaacccacacagaccctcacgctgacctgcaccttctctgggttctcgctcagcactagtgcagtgggtgtgggctggatccggcagcccccaggaaaggccctggagtggcttgcactcatctattgggatgatgataagcgctacagcccatctctgaagagcaggctcaccatcaccaaggacacctccaaaaaccagctggtccttacaatgaccaacgtggaccctgtggacacagccacatattactgtgcacaccacacgatacaactaatctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 831 - protein, 449 aa, synthetic construct
  REGION 1..449: note = Synthetic
QITLKESGPTLVKPTQTLTLTCTFSGFSLSTSAVGVGWIRQPPGKALEWLALIYWDDDKRYSPSLKSRLTITKDTSKNQLVLTMTNVDPVDTATYYCAHHTIQLIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 832 - DNA, 654 bp, synthetic construct
  misc_feature 1..654: note = Synthetic
  source 1..654: mol_type = other DNA
cagtctgccctgactcagcctgcctccgtgtctgggtctcctggacagtcgatcaccatctcctgcactgcaaccagcagtgacgttggtaattataactatgtctcctggtaccaacagcacccaggcaaagcccccaaactcatgatttatgaggtcagtaatcggccctcaggggtttctaatcggttctctggctccaagtctggcaacacggcctccctgaccatctctgggctccaggctgaggacgaggctgattattactgcagctcatatacaagcagcagcacccctttggtattcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 833 - protein, 217 aa, synthetic construct
  REGION 1..217: note = Synthetic
QSALTQPASVSGSPGQSITISCTATSSDVGNYNYVSWYQQHPGKAPKLMIYEVSNRPSGVSNRFSGSKSGNTASLTISGLQAEDEADYYCSSYTSSSTPLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 834 - DNA, 390 bp, synthetic construct
  misc_feature 1..390: note = Synthetic
  source 1..390: mol_type = other DNA
caggtccagctggtacagtctggggctgaggtgaagaagcctggggcctcagtgaaggtctcctgcaaggtttccggatacaccctcactgaattatccatacactgggtgcgacaggctcctggaaaagggcttgagtggatgggaggttttaatcctgaagatgctgaaacaatctacgcacagaagttccagggcagagtcaccatgaccgaggacacatctacagacacagcctacatggagctgagggccctgagatttgaggacacggccgtgtattactgtgcaacagctttcgccgtagtctcagttggtacgggtctgaattataactactactacggcatggacgtctggggccaagggaccacggtcaccgtctcctca

SEQ ID NO: 835 - protein, 130 aa, synthetic construct
  REGION 1..130: note = Synthetic
QVQLVQSGAEVKKPGASVKVSCKVSGYTLTELSIHWVRQAPGKGLEWMGGFNPEDAETIYAQKFQGRVTMTEDTSTDTAYMELRALRFEDTAVYYCATAFAVVSVGTGLNYNYYYGMDVWGQGTTVTVSS

SEQ ID NO: 836 - DNA, 24 bp, synthetic construct
  misc_feature 1..24: note = Synthetic
  source 1..24: mol_type = other DNA
ggatacaccctcactgaattatcc

SEQ ID NO: 837 - protein, 8 aa, synthetic construct
  REGION 1..8: note = Synthetic
GYTLTELS

SEQ ID NO: 838 - DNA, 24 bp, synthetic construct
  misc_feature 1..24: note = Synthetic
  source 1..24: mol_type = other DNA
tttaatcctgaagatgctgaaaca

SEQ ID NO: 839 - protein, 8 aa, synthetic construct
  REGION 1..8: note = Synthetic
FNPEDAET

SEQ ID NO: 840 - DNA, 69 bp, synthetic construct
  misc_feature 1..69: note = Synthetic
  source 1..69: mol_type = other DNA
gcaacagctttcgccgtagtctcagttggtacgggtctgaattataactactactacggcatggacgtc

SEQ ID NO: 841 - protein, 23 aa, synthetic construct
  REGION 1..23: note = Synthetic
ATAFAVVSVGTGLNYNYYYGMDV

SEQ ID NO: 842 - DNA, 336 bp, synthetic construct
  misc_feature 1..336: note = Synthetic
  source 1..336: mol_type = other DNA
gatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccgtttctccggggtcccagacagattcagtggcagtggggcagggacagatttcacactgaaaatcagcatggtggaagctgaggatgtcggggtttattactgcacgcaagctacacaatttccgtacacttttggccaggggaccaacctggagatcaaa

SEQ ID NO: 843 - protein, 112 aa, synthetic construct
  REGION 1..112: note = Synthetic
DIVMTQTPLSSPVTLGQPASISCRSSQSLVHSDGNTYLSWLQQRPGQPPRLLIYKISNRFSGVPDRFSGSGAGTDFTLKISMVEAEDVGVYYCTQATQFPYTFGQGTNLEIK

SEQ ID NO: 844 - DNA, 33 bp, synthetic construct
  misc_feature 1..33: note = Synthetic
  source 1..33: mol_type = other DNA
caaagcctcgtacacagtgatggaaacacctac

SEQ ID NO: 845 - protein, 11 aa, synthetic construct
  REGION 1..11: note = Synthetic
QSLVHSDGNTY

SEQ ID NO: 846-847 - skipped (2 entries)

SEQ ID NO: 848 - DNA, 27 bp, synthetic construct
  misc_feature 1..27: note = Synthetic
  source 1..27: mol_type = other DNA
acgcaagctacacaatttccgtacact

SEQ ID NO: 849 - protein, 9 aa, synthetic construct
  REGION 1..9: note = Synthetic
TQATQFPYT

SEQ ID NO: 850 - DNA, 1383 bp, synthetic construct
  misc_feature 1..1383: note = Synthetic
  source 1..1383: mol_type = other DNA
caggtccagctggtacagtctggggctgaggtgaagaagcctggggcctcagtgaaggtctcctgcaaggtttccggatacaccctcactgaattatccatacactgggtgcgacaggctcctggaaaagggcttgagtggatgggaggttttaatcctgaagatgctgaaacaatctacgcacagaagttccagggcagagtcaccatgaccgaggacacatctacagacacagcctacatggagctgagggccctgagatttgaggacacggccgtgtattactgtgcaacagctttcgccgtagtctcagttggtacgggtctgaattataactactactacggcatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 851 - protein, 460 aa, synthetic construct
  REGION 1..460: note = Synthetic
QVQLVQSGAEVKKPGASVKVSCKVSGYTLTELSIHWVRQAPGKGLEWMGGFNPEDAETIYAQKFQGRVTMTEDTSTDTAYMELRALRFEDTAVYYCATAFAVVSVGTGLNYNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 852 - DNA, 660 bp, synthetic construct
  misc_feature 1..660: note = Synthetic
  source 1..660: mol_type = other DNA
gatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccgtttctccggggtcccagacagattcagtggcagtggggcagggacagatttcacactgaaaatcagcatggtggaagctgaggatgtcggggtttattactgcacgcaagctacacaatttccgtacacttttggccaggggaccaacctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 853 - protein, 219 aa, synthetic construct
  REGION 1..219: note = Synthetic
DIVMTQTPLSSPVTLGQPASISCRSSQSLVHSDGNTYLSWLQQRPGQPPRLLIYKISNRFSGVPDRFSGSGAGTDFTLKISMVEAEDVGVYYCTQATQFPYTFGQGTNLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 854 - DNA, 369 bp, synthetic construct
  misc_feature 1..369: note = Synthetic
  source 1..369: mol_type = other DNA
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggacggatcaacccttacagtggtggcacaaactatgcacagaagtttcagggcagggtcaccatgaccagggacacgtccatcagcacagcctacatggagctgagcaggctgagatctgacgacacggccgtgtattactgtgcgagcggtttcgagccgcatgactacggtgacccgaacctccctccctggggccagggaaccctggtcaccgtctcctca

SEQ ID NO: 855 - protein, 123 aa, synthetic construct
  REGION 1..123: note = Synthetic
QVQLVQSGAEVKKPGASVKVSCKASGYTFTGYYMHWVRQAPGQGLEWMGRINPYSGGTNYAQKFQGRVTMTRDTSISTAYMELSRLRSDDTAVYYCASGFEPHDYGDPNLPPWGQGTLVTVSS

SEQ ID NO: 856 - DNA, 24 bp, synthetic construct
  misc_feature 1..24: note = Synthetic
  source 1..24: mol_type = other DNA
ggatacaccttcaccggctactat

SEQ ID NO: 857 - protein, 8 aa, synthetic construct
  REGION 1..8: note = Synthetic
GYTFTGYY

SEQ ID NO: 858 - DNA, 24 bp, synthetic construct
  misc_feature 1..24: note = Synthetic
  source 1..24: mol_type = other DNA
atcaacccttacagtggtggcaca

SEQ ID NO: 859 - protein, 8 aa, synthetic construct
  REGION 1..8: note = Synthetic
INPYSGGT

SEQ ID NO: 860 - DNA, 48 bp, synthetic construct
  misc_feature 1..48: note = Synthetic
  source 1..48: mol_type = other DNA
gcgagcggtttcgagccgcatgactacggtgacccgaacctccctccc

SEQ ID NO: 861 - protein, 16 aa, synthetic construct
  REGION 1..16: note = Synthetic
ASGFEPHDYGDPNLPP

SEQ ID NO: 862 - DNA, 324 bp, synthetic construct
  misc_feature 1..324: note = Synthetic
  source 1..324: mol_type = other DNA
gacatccagatgacccagtctccatcctccctgtctgcatctgtaggagacagagtcaccatcacttgccgggcaagtcagagcattagcaactatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacactcctacagtacccctccggtcactttcggcggagggaccaaggtggagatcaaa

SEQ ID NO: 863 - protein, 108 aa, synthetic construct
  REGION 1..108: note = Synthetic
DIQMTQSPSSLSASVGDRVTITCRASQSISNYLNWYQQKPGKAPKLLIYAASSLQSGVPSRFSGSGSGTDFTLTISSLQPEDFATYYCQHSYSTPPVTFGGGTKVEIK

SEQ ID NO: 864 - DNA, 18 bp, synthetic construct
  misc_feature 1..18: note = Synthetic
  source 1..18: mol_type = other DNA
cagagcattagcaactat

SEQ ID NO: 865 - protein, 6 aa, synthetic construct
  REGION 1..6: note = Synthetic
QSISNY

SEQ ID NO: 866 - DNA, 30 bp, synthetic construct
  misc_feature 1..30: note = Synthetic
  source 1..30: mol_type = other DNA
caacactcctacagtacccctccggtcact

SEQ ID NO: 867 - protein, 10 aa, synthetic construct
  REGION 1..10: note = Synthetic
QHSYSTPPVT

SEQ ID NO: 868 - DNA, 1362 bp, synthetic construct
  misc_feature 1..1362: note = Synthetic
  source 1..1362: mol_type = other DNA
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggacggatcaacccttacagtggtggcacaaactatgcacagaagtttcagggcagggtcaccatgaccagggacacgtccatcagcacagcctacatggagctgagcaggctgagatctgacgacacggccgtgtattactgtgcgagcggtttcgagccgcatgactacggtgacccgaacctccctccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 869 - protein, 453 aa, synthetic construct
  REGION 1..453: note = Synthetic
QVQLVQSGAEVKKPGASVKVSCKASGYTFTGYYMHWVRQAPGQGLEWMGRINPYSGGTNYAQKFQGRVTMTRDTSISTAYMELSRLRSDDTAVYYCASGFEPHDYGDPNLPPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 870 - DNA, 648 bp, synthetic construct
  misc_feature 1..648: note = Synthetic
  source 1..648: mol_type = other DNA
gacatccagatgacccagtctccatcctccctgtctgcatctgtaggagacagagtcaccatcacttgccgggcaagtcagagcattagcaactatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacactcctacagtacccctccggtcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 871 - protein, 215 aa, synthetic construct
  REGION 1..215: note = Synthetic
DIQMTQSPSSLSASVGDRVTITCRASQSISNYLNWYQQKPGKAPKLLIYAASSLQSGVPSRFSGSGSGTDFTLTISSLQPEDFATYYCQHSYSTPPVTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 872 - DNA, 369 bp, synthetic construct
  misc_feature 1..369: note = Synthetic
  source 1..369: mol_type = other DNA
caggtgcagctgcaggagtcggggccaggactggtgaagccttcggagaccctgtccctcacctgcactgtctctggtggctccatcagtggttactactggagttggatccggcagcccccagggaagggactggactggattggatatatctattacagggggaacaccaactacaacccctcccttaagagtcgagtcaccatctcagtagacacgtctaacaaccagttctccctgaagctgagctctgtgaccgctgcggacacggccgtttattactgcgcgagatatggggaggggtacggtgatgctagtggttatcactttgactactggggccagggaaccctggtcaccgtctcctca

SEQ ID NO: 873 - protein, 123 aa, synthetic construct
  REGION 1..123: note = Synthetic
QVQLQESGPGLVKPSETLSLTCTVSGGSISGYYWSWIRQPPGKGLDWIGYIYYRGNTNYNPSLKSRVTISVDTSNNQFSLKLSSVTAADTAVYYCARYGEGYGDASGYHFDYWGQGTLVTVSS

SEQ ID NO: 874 - DNA, 24 bp, synthetic construct
  misc_feature 1..24: note = Synthetic
  source 1..24: mol_type = other DNA
ggtggctccatcagtggttactac

SEQ ID NO: 875 - DNA, 21 bp, synthetic construct
  misc_feature 1..21: note = Synthetic
  source 1..21: mol_type = other DNA
atctattacagggggaacacc

SEQ ID NO: 876 - protein, 7 aa, synthetic construct
  REGION 1..7: note = Synthetic
IYYRGNT

SEQ ID NO: 877 - DNA, 51 bp, synthetic construct
  misc_feature 1..51: note = Synthetic
  source 1..51: mol_type = other DNA
gcgagatatggggaggggtacggtgatgctagtggttatcactttgactac

SEQ ID NO: 878 - protein, 17 aa, synthetic construct
  REGION 1..17: note = Synthetic
ARYGEGYGDASGYHFDY

SEQ ID NO: 879 - DNA, 330 bp, synthetic construct
  misc_feature 1..330: note = Synthetic
  source 1..330: mol_type = other DNA
cagtctgccctgactcagcctgcctccgtgtctggctctcctggacagtcgatcaccatctcctgcactggaaccagcagtgatgttgggagttataaccttgtctcctggtaccaacagcacccaggcaaagcccccaaactcatgatttatgaggacagtaagcggccctcaggggttgctaatcccttctctggctccaagtctggcaacacggcctccctgacaatctctgggctccaggctgaggacgaggctgattattactgctcctcatatgcaggtagtagtacttgggtgttcggcggagggaccaagctgaccgtccta

SEQ ID NO: 880 - protein, 110 aa, synthetic construct
  REGION 1..110: note = Synthetic
QSALTQPASVSGSPGQSITISCTGTSSDVGSYNLVSWYQQHPGKAPKLMIYEDSKRPSGVANPFSGSKSGNTASLTISGLQAEDEADYYCSSYAGSSTWVFGGGTKLTVL

SEQ ID NO: 881 - DNA, 30 bp, synthetic construct
  misc_feature 1..30: note = Synthetic
  source 1..30: mol_type = other DNA
tcctcatatgcaggtagtagtacttgggtg

SEQ ID NO: 882 - DNA, 1362 bp, synthetic construct
  misc_feature 1..1362: note = Synthetic
  source 1..1362: mol_type = other DNA
caggtgcagctgcaggagtcggggccaggactggtgaagccttcggagaccctgtccctcacctgcactgtctctggtggctccatcagtggttactactggagttggatccggcagcccccagggaagggactggactggattggatatatctattacagggggaacaccaactacaacccctcccttaagagtcgagtcaccatctcagtagacacgtctaacaaccagttctccctgaagctgagctctgtgaccgctgcggacacggccgtttattactgcgcgagatatggggaggggtacggtgatgctagtggttatcactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 883 - protein, 453 aa, synthetic construct
  REGION 1..453: note = Synthetic
QVQLQESGPGLVKPSETLSLTCTVSGGSISGYYWSWIRQPPGKGLDWIGYIYYRGNTNYNPSLKSRVTISVDTSNNQFSLKLSSVTAADTAVYYCARYGEGYGDASGYHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 884 - DNA, 651 bp, synthetic construct
  misc_feature 1..651: note = Synthetic
  source 1..651: mol_type = other DNA
cagtctgccctgactcagcctgcctccgtgtctggctctcctggacagtcgatcaccatctcctgcactggaaccagcagtgatgttgggagttataaccttgtctcctggtaccaacagcacccaggcaaagcccccaaactcatgatttatgaggacagtaagcggccctcaggggttgctaatcccttctctggctccaagtctggcaacacggcctccctgacaatctctgggctccaggctgaggacgaggctgattattactgctcctcatatgcaggtagtagtacttgggtgttcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 885 - protein, 216 aa, synthetic construct
  REGION 1..216: note = Synthetic
QSALTQPASVSGSPGQSITISCTGTSSDVGSYNLVSWYQQHPGKAPKLMIYEDSKRPSGVANPFSGSKSGNTASLTISGLQAEDEADYYCSSYAGSSTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 886 - DNA, 363 bp, synthetic construct
  misc_feature 1..363: note = Synthetic
  source 1..363: mol_type = other DNA
caggtgcagctgcaggagtcgggcccaggactggtgaagccttcggagaccctgtccctcacctgcactgtctctggtggctccatcagtagtcactactggagctggatccggcagcccccagggaagggactggaatggattgggtatatttattacagcgggagctccaactacaacccctccctcaagagtcgagtcaccatatcagtagacacgtccaagaaccagttctccctgaaactgaattctgtgaccgccgcagacacggccgtgtattactgtgcgagacattacgatattttgactggttttgactggttcgacccctggggccagggaaccctggtcaccgtctcctca

SEQ ID NO: 887 - protein, 121 aa, synthetic construct
  REGION 1..121: note = Synthetic
QVQLQESGPGLVKPSETLSLTCTVSGGSISSHYWSWIRQPPGKGLEWIGYIYYSGSSNYNPSLKSRVTISVDTSKNQFSLKLNSVTAADTAVYYCARHYDILTGFDWFDPWGQGTLVTVSS

SEQ ID NO: 888 - DNA, 24 bp, synthetic construct
  misc_feature 1..24: note = Synthetic
  source 1..24: mol_type = other DNA
ggtggctccatcagtagtcactac

SEQ ID NO: 889 - protein, 8 aa, synthetic construct
  REGION 1..8: note = Synthetic
GGSISSHY

SEQ ID NO: 890 - DNA, 21 bp, synthetic construct
  misc_feature 1..21: note = Synthetic
  source 1..21: mol_type = other DNA
atttattacagcgggagctcc

SEQ ID NO: 891 - protein, 7 aa, synthetic construct
  REGION 1..7: note = Synthetic
IYYSGSS

SEQ ID NO: 892 - DNA, 45 bp, synthetic construct
  misc_feature 1..45: note = Synthetic
  source 1..45: mol_type = other DNA
gcgagacattacgatattttgactggttttgactggttcgacccc

SEQ ID NO: 893 - protein, 15 aa, synthetic construct
  REGION 1..15: note = Synthetic
ARHYDILTGFDWFDP

SEQ ID NO: 894 - DNA, 336 bp, synthetic construct
  misc_feature 1..336: note = Synthetic
  source 1..336: mol_type = other DNA
cagtctgtgctgacgcagccgccctcagtgtcaggggccccagggcagagggtcaccatctcctgcactgggagcagttccaacatcgggacacattatgatgtacactggtaccaacaacttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctttgacaacagcctgactgccccttatgtcttcggaactgggaccaaggtcaccgtccta

SEQ ID NO: 895 - protein, 112 aa, synthetic construct
  REGION 1..112: note = Synthetic
QSVLTQPPSVSGAPGQRVTISCTGSSSNIGTHYDVHWYQQLPGTAPKLLIYGNSNRPSGVPDRFSGSKSGTSASLAITGLQAEDEADYYCQSFDNSLTAPYVFGTGTKVTVL

SEQ ID NO: 896 - DNA, 27 bp, synthetic construct
  misc_feature 1..27: note = Synthetic
  source 1..27: mol_type = other DNA
agttccaacatcgggacacattatgat

SEQ ID NO: 897 - protein, 9 aa, synthetic construct
  REGION 1..9: note = Synthetic
SSNIGTHYD

SEQ ID NO: 898 - DNA, 36 bp, synthetic construct
  misc_feature 1..36: note = Synthetic
  source 1..36: mol_type = other DNA
cagtcctttgacaacagcctgactgccccttatgtc

SEQ ID NO: 899 - protein, 12 aa, synthetic construct
  REGION 1..12: note = Synthetic
QSFDNSLTAPYV

SEQ ID NO: 900 - DNA, 1356 bp, synthetic construct
  misc_feature 1..1356: note = Synthetic
  source 1..1356: mol_type = other DNA
caggtgcagctgcaggagtcgggcccaggactggtgaagccttcggagaccctgtccctcacctgcactgtctctggtggctccatcagtagtcactactggagctggatccggcagcccccagggaagggactggaatggattgggtatatttattacagcgggagctccaactacaacccctccctcaagagtcgagtcaccatatcagtagacacgtccaagaaccagttctccctgaaactgaattctgtgaccgccgcagacacggccgtgtattactgtgcgagacattacgatattttgactggttttgactggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 901 - protein, 451 aa, synthetic construct
  REGION 1..451: note = Synthetic
QVQLQESGPGLVKPSETLSLTCTVSGGSISSHYWSWIRQPPGKGLEWIGYIYYSGSSNYNPSLKSRVTISVDTSKNQFSLKLNSVTAADTAVYYCARHYDILTGFDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 902 - DNA, 657 bp, synthetic construct
  misc_feature 1..657: note = Synthetic
  source 1..657: mol_type = other DNA
cagtctgtgctgacgcagccgccctcagtgtcaggggccccagggcagagggtcaccatctcctgcactgggagcagttccaacatcgggacacattatgatgtacactggtaccaacaacttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctttgacaacagcctgactgccccttatgtcttcggaactgggaccaaggtcaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 903 - protein, 218 aa, synthetic construct
  REGION 1..218: note = Synthetic
QSVLTQPPSVSGAPGQRVTISCTGSSSNIGTHYDVHWYQQLPGTAPKLLIYGNSNRPSGVPDRFSGSKSGTSASLAITGLQAEDEADYYCQSFDNSLTAPYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 904 - DNA, 360 bp, synthetic construct
  misc_feature 1..360: note = Synthetic
  source 1..360: mol_type = other DNA
gaggtgcagctggtggagtctggaggaggcttggtccagccgggggggtccctgagactctcctgtgcagcctctgggttcaccgtcagtagaagctatatgaactgggtccgccaggctccagggaaggggctggagtgggtctcagttgttttcaccggtggtaccacaaagcacacagactccgtgaagggccgattcaccatctccagagacaattccatgaacacgttgtatcttcaaatgaacagtttgagacctgaagacacggccgtgtactactgtgcgagagtcgctatagttgaaactacaggggcttttgatatttggggccaagggacaatggtcaccgtctcttca

SEQ ID NO: 905 - protein, 120 aa, synthetic construct
  REGION 1..120: note = Synthetic
EVQLVESGGGLVQPGGSLRLSCAASGFTVSRSYMNWVRQAPGKGLEWVSVVFTGGTTKHTDSVKGRFTISRDNSMNTLYLQMNSLRPEDTAVYYCARVAIVETTGAFDIWGQGTMVTVSS

SEQ ID NO: 906 - DNA, 24 bp, synthetic construct
  misc_feature 1..24: note = Synthetic
  source 1..24: mol_type = other DNA
gggttcaccgtcagtagaagctat

SEQ ID NO: 907 - DNA, 21 bp, synthetic construct
  misc_feature 1..21: note = Synthetic
  source 1..21: mol_type = other DNA
gttttcaccggtggtaccaca

SEQ ID NO: 908 - protein, 7 aa, synthetic construct
  REGION 1..7: note = Synthetic
VFTGGTT

SEQ ID NO: 909 - DNA, 42 bp, synthetic construct
  misc_feature 1..42: note = Synthetic
  source 1..42: mol_type = other DNA
gcgagagtcgctatagttgaaactacaggggcttttgatatt

SEQ ID NO: 910 - protein, 14 aa, synthetic construct
  REGION 1..14: note = Synthetic
ARVAIVETTGAFDI

SEQ ID NO: 911 - DNA, 336 bp, synthetic construct
  misc_feature 1..336: note = Synthetic
  source 1..336: mol_type = other DNA
cagtctgtgctgacgcagccgccctcagtgtctggggccccagggcagagggtcaccatctcctgcactgggaccagctccaacatcggggcggattttgatgtacactggtaccagcagtttccaggaacagcccccaaactcctcatctatggtcacaccaatcggccctcagggatccctgaccgattctctggctccaagtctggcacctcagcctccctggccatcactgggctccaggctgaggatgaggctgattattactgccagtcctatgacagcagcctgagtggttctgtggtattcggcggagggaccaagctgaccgtccta

SEQ ID NO: 912 - protein, 112 aa, synthetic construct
  REGION 1..112: note = Synthetic
QSVLTQPPSVSGAPGQRVTISCTGTSSNIGADFDVHWYQQFPGTAPKLLIYGHTNRPSGIPDRFSGSKSGTSASLAITGLQAEDEADYYCQSYDSSLSGSVVFGGGTKLTVL

SEQ ID NO: 913 - DNA, 27 bp, synthetic construct
  misc_feature 1..27: note = Synthetic
  source 1..27: mol_type = other DNA
agctccaacatcggggcggattttgat

SEQ ID NO: 914 - protein, 9 aa, synthetic construct
  REGION 1..9: note = Synthetic
SSNIGADFD

SEQ ID NO: 915-916 - skipped (2 entries)

SEQ ID NO: 917 - DNA, 1353 bp, synthetic construct
  misc_feature 1..1353: note = Synthetic
  source 1..1353: mol_type = other DNA
gaggtgcagctggtggagtctggaggaggcttggtccagccgggggggtccctgagactctcctgtgcagcctctgggttcaccgtcagtagaagctatatgaactgggtccgccaggctccagggaaggggctggagtgggtctcagttgttttcaccggtggtaccacaaagcacacagactccgtgaagggccgattcaccatctccagagacaattccatgaacacgttgtatcttcaaatgaacagtttgagacctgaagacacggccgtgtactactgtgcgagagtcgctatagttgaaactacaggggcttttgatatttggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 918 - protein, 450 aa, synthetic construct
  REGION 1..450: note = Synthetic
EVQLVESGGGLVQPGGSLRLSCAASGFTVSRSYMNWVRQAPGKGLEWVSVVFTGGTTKHTDSVKGRFTISRDNSMNTLYLQMNSLRPEDTAVYYCARVAIVETTGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 919 - DNA, 657 bp, synthetic construct
  misc_feature 1..657: note = Synthetic
  source 1..657: mol_type = other DNA
cagtctgtgctgacgcagccgccctcagtgtctggggccccagggcagagggtcaccatctcctgcactgggaccagctccaacatcggggcggattttgatgtacactggtaccagcagtttccaggaacagcccccaaactcctcatctatggtcacaccaatcggccctcagggatccctgaccgattctctggctccaagtctggcacctcagcctccctggccatcactgggctccaggctgaggatgaggctgattattactgccagtcctatgacagcagcctgagtggttctgtggtattcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 920 - protein, 218 aa, synthetic construct
  REGION 1..218: note = Synthetic
QSVLTQPPSVSGAPGQRVTISCTGTSSNIGADFDVHWYQQFPGTAPKLLIYGHTNRPSGIPDRFSGSKSGTSASLAITGLQAEDEADYYCQSYDSSLSGSVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 921 - DNA, 357 bp, synthetic construct
  misc_feature 1..357: note = Synthetic
  source 1..357: mol_type = other DNA
cagctgcagctgcaggagtcgggcccaggactggtgaagccttcggagaccctgtccctcatttgcactggctctggtgactccatcagcagtagtcattactactggggctggatccgccagcccccagggaaggggctggagtggattggcagtacctattttagtgggagcacctattacaacccgtccctcaagagtcgagtctccatatccgtagacacgtccaagaaccaggtctccctgaaactgatttctgtgaccgccgcagacacggctgtgtattactgtgcgagagaaatgggagctactctaggggactactggggcccgggaaccctggtcaccgtctcctca

SEQ ID NO: 922 - protein, 119 aa, synthetic construct
  REGION 1..119: note = Synthetic
QLQLQESGPGLVKPSETLSLICTGSGDSISSSHYYWGWIRQPPGKGLEWIGSTYFSGSTYYNPSLKSRVSISVDTSKNQVSLKLISVTAADTAVYYCAREMGATLGDYWGPGTLVTVSS

SEQ ID NO: 923 - DNA, 30 bp, synthetic construct
  misc_feature 1..30: note = Synthetic
  source 1..30: mol_type = other DNA
ggtgactccatcagcagtagtcattactac

SEQ ID NO: 924 - protein, 10 aa, synthetic construct
  REGION 1..10: note = Synthetic
GDSISSSHYY

SEQ ID NO: 925 - DNA, 21 bp, synthetic construct
  misc_feature 1..21: note = Synthetic
  source 1..21: mol_type = other DNA
acctattttagtgggagcacc

SEQ ID NO: 926 - protein, 7 aa, synthetic construct
  REGION 1..7: note = Synthetic
TYFSGST

SEQ ID NO: 927 - DNA, 33 bp, synthetic construct
  misc_feature 1..33: note = Synthetic
  source 1..33: mol_type = other DNA
gcgagagaaatgggagctactctaggggactac

SEQ ID NO: 928 - protein, 11 aa, synthetic construct
  REGION 1..11: note = Synthetic
AREMGATLGDY

SEQ ID NO: 929 - DNA, 333 bp, synthetic construct
  misc_feature 1..333: note = Synthetic
  source 1..333: mol_type = other DNA
cagtctgtgctgactcagccaccctcagcgtctgggacccccggacagagggtcaccatctcttgttctggaagcagctccaacatcggaaataattatgtatactggtatcagcagttcccaggaacgacccccagactcctcatctataggaataatgagcggccctcaggggtccctgaccgattctctggctccaagtctggcacctcagcctccctggtcatcagtgggctccggtccgaggatgaggctgattattactgtgcagcatgggatgacagcctgagtgcccattatgtcttcggaactgggaccaaggtcaccgtccta

SEQ ID NO: 930 - protein, 111 aa, synthetic construct
  REGION 1..111: note = Synthetic
QSVLTQPPSASGTPGQRVTISCSGSSSNIGNNYVYWYQQFPGTTPRLLIYRNNERPSGVPDRFSGSKSGTSASLVISGLRSEDEADYYCAAWDDSLSAHYVFGTGTKVTVL

SEQ ID NO: 931 - DNA, 24 bp, synthetic construct
  misc_feature 1..24: note = Synthetic
  source 1..24: mol_type = other DNA
agctccaacatcggaaataattat

SEQ ID NO: 932-933 - skipped (2 entries)

SEQ ID NO: 934 - DNA, 36 bp, synthetic construct
  misc_feature 1..36: note = Synthetic
  source 1..36: mol_type = other DNA
gcagcatgggatgacagcctgagtgcccattatgtc

SEQ ID NO: 935 - protein, 12 aa, synthetic construct
  REGION 1..12: note = Synthetic
AAWDDSLSAHYV

SEQ ID NO: 936 - DNA, 1350 bp, synthetic construct
  misc_feature 1..1350: note = Synthetic
  source 1..1350: mol_type = other DNA
cagctgcagctgcaggagtcgggcccaggactggtgaagccttcggagaccctgtccctcatttgcactggctctggtgactccatcagcagtagtcattactactggggctggatccgccagcccccagggaaggggctggagtggattggcagtacctattttagtgggagcacctattacaacccgtccctcaagagtcgagtctccatatccgtagacacgtccaagaaccaggtctccctgaaactgatttctgtgaccgccgcagacacggctgtgtattactgtgcgagagaaatgggagctactctaggggactactggggcccgggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 937 - protein, 449 aa, synthetic construct
  REGION 1..449: note = Synthetic
QLQLQESGPGLVKPSETLSLICTGSGDSISSSHYYWGWIRQPPGKGLEWIGSTYFSGSTYYNPSLKSRVSISVDTSKNQVSLKLISVTAADTAVYYCAREMGATLGDYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 938 - DNA, 654 bp, synthetic construct
  misc_feature 1..654: note = Synthetic
  source 1..654: mol_type = other DNA
cagtctgtgctgactcagccaccctcagcgtctgggacccccggacagagggtcaccatctcttgttctggaagcagctccaacatcggaaataattatgtatactggtatcagcagttcccaggaacgacccccagactcctcatctataggaataatgagcggccctcaggggtccctgaccgattctctggctccaagtctggcacctcagcctccctggtcatcagtgggctccggtccgaggatgaggctgattattactgtgcagcatgggatgacagcctgagtgcccattatgtcttcggaactgggaccaaggtcaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 939 - protein, 217 aa, synthetic construct
  REGION 1..217: note = Synthetic
QSVLTQPPSASGTPGQRVTISCSGSSSNIGNNYVYWYQQFPGTTPRLLIYRNNERPSGVPDRFSGSKSGTSASLVISGLRSEDEADYYCAAWDDSLSAHYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 940 - DNA, 378 bp, synthetic construct
  misc_feature 1..378: note = Synthetic
  source 1..378: mol_type = other DNA
gaggtgcagctggtggagtctgggggaggcttggtacagcctggagggtccctgagactctcctgtgcagcctctggattccccttcagtacttatgaaatgaattgggtccgccaggctccagggaaggggctggagtgggtttcatacattagtagtagtggtaataccatatactacgcagactctgtgaagggccgattcaccatctccagagacaacgccaagaactcactgtatctgcaaatgaacaccctgagagccgaggacacggctgtttattattgtgcgagagatgctgtaagggatcacgatattttgactgacccagcgacgttcgacccctggggccagggaaccctggtcaccgtctcctca

SEQ ID NO: 941 - protein, 126 aa, synthetic construct
  REGION 1..126: note = Synthetic
EVQLVESGGGLVQPGGSLRLSCAASGFPFSTYEMNWVRQAPGKGLEWVSYISSSGNTIYYADSVKGRFTISRDNAKNSLYLQMNTLRAEDTAVYYCARDAVRDHDILTDPATFDPWGQGTLVTVSS

SEQ ID NO: 942 - DNA, 24 bp, synthetic construct
  misc_feature 1..24: note = Synthetic
  source 1..24: mol_type = other DNA
ggattccccttcagtacttatgaa

SEQ ID NO: 943 - protein, 8 aa, synthetic construct
  REGION 1..8: note = Synthetic
GFPFSTYE

SEQ ID NO: 944 - DNA, 24 bp, synthetic construct
  misc_feature 1..24: note = Synthetic
  source 1..24: mol_type = other DNA
attagtagtagtggtaataccata

SEQ ID NO: 945 - protein, 8 aa, synthetic construct
  REGION 1..8: note = Synthetic
ISSSGNTI

SEQ ID NO: 946 - DNA, 57 bp, synthetic construct
  misc_feature 1..57: note = Synthetic
  source 1..57: mol_type = other DNA
gcgagagatgctgtaagggatcacgatattttgactgacccagcgacgttcgacccc

SEQ ID NO: 947 - protein, 19 aa, synthetic construct
  REGION 1..19: note = Synthetic
ARDAVRDHDILTDPATFDP

SEQ ID NO: 948 - DNA, 336 bp, synthetic construct
  misc_feature 1..336: note = Synthetic
  source 1..336: mol_type = other DNA
gatattgtgatgactcagtctccactctccctgcccgtcacccctggagagccggcctccatctcctgcaggtctagtcagaccctcctgcatagtaatggatacaactatttggattggtacctgcagaagccagggcagtctccacagctcctgatccatttgggttctaatcgggcctccggggtccctgacaggttcagtggcagtggatcagtcacagattttacactgaaaatcagcagagtggaggctgaggatgttggggtttattactgcatgcaagctctacaaactccgtacacttttggccaggggaccaagctggagatcaaa

SEQ ID NO: 949 - protein, 112 aa, synthetic construct
  REGION 1..112: note = Synthetic
DIVMTQSPLSLPVTPGEPASISCRSSQTLLHSNGYNYLDWYLQKPGQSPQLLIHLGSNRASGVPDRFSGSGSVTDFTLKISRVEAEDVGVYYCMQALQTPYTFGQGTKLEIK

SEQ ID NO: 950 - DNA, 33 bp, synthetic construct
  misc_feature 1..33: note = Synthetic
  source 1..33: mol_type = other DNA
cagaccctcctgcatagtaatggatacaactat

SEQ ID NO: 951 - protein, 11 aa, synthetic construct
  REGION 1..11: note = Synthetic
QTLLHSNGYNY

SEQ ID NO: 952 - DNA, 1371 bp, synthetic construct
  misc_feature 1..1371: note = Synthetic
  source 1..1371: mol_type = other DNA
gaggtgcagctggtggagtctgggggaggcttggtacagcctggagggtccctgagactctcctgtgcagcctctggattccccttcagtacttatgaaatgaattgggtccgccaggctccagggaaggggctggagtgggtttcatacattagtagtagtggtaataccatatactacgcagactctgtgaagggccgattcaccatctccagagacaacgccaagaactcactgtatctgcaaatgaacaccctgagagccgaggacacggctgtttattattgtgcgagagatgctgtaagggatcacgatattttgactgacccagcgacgttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 953 - protein, 456 aa, synthetic construct
  REGION 1..456: note = Synthetic
EVQLVESGGGLVQPGGSLRLSCAASGFPFSTYEMNWVRQAPGKGLEWVSYISSSGNTIYYADSVKGRFTISRDNAKNSLYLQMNTLRAEDTAVYYCARDAVRDHDILTDPATFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 954 - DNA, 660 bp, synthetic construct
  misc_feature 1..660: note = Synthetic
  source 1..660: mol_type = other DNA
gatattgtgatgactcagtctccactctccctgcccgtcacccctggagagccggcctccatctcctgcaggtctagtcagaccctcctgcatagtaatggatacaactatttggattggtacctgcagaagccagggcagtctccacagctcctgatccatttgggttctaatcgggcctccggggtccctgacaggttcagtggcagtggatcagtcacagattttacactgaaaatcagcagagtggaggctgaggatgttggggtttattactgcatgcaagctctacaaactccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 955 - protein, 219 aa, synthetic construct
  REGION 1..219: note = Synthetic
DIVMTQSPLSLPVTPGEPASISCRSSQTLLHSNGYNYLDWYLQKPGQSPQLLIHLGSNRASGVPDRFSGSGSVTDFTLKISRVEAEDVGVYYCMQALQTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 956 - DNA, 357 bp, synthetic construct
  misc_feature 1..357: note = Synthetic
  source 1..357: mol_type = other DNA
gaggtgcagctggtggagtctgggggaggcttggtacagcctggagggtccctgagactctcctgtgcagcctctggattcaccttcagtatttatgaaatgaactgggtccgccaggctccagggaaggggctggagtgggtttcatacattactagtagtggttttaccatatactacgcagactctgtgaagggccgattcaccatctccagagacaacgccaagaactcactgtatctgcaaatgcacagcctgagagccgaggacacggctgtttattactgtgcgactagcagctcgtccggatactactttgattactggggccagggaaccctggtcaccgtctcctca

SEQ ID NO: 957 - protein, 119 aa, synthetic construct
  REGION 1..119: note = Synthetic
EVQLVESGGGLVQPGGSLRLSCAASGFTFSIYEMNWVRQAPGKGLEWVSYITSSGFTIYYADSVKGRFTISRDNAKNSLYLQMHSLRAEDTAVYYCATSSSSGYYFDYWGQGTLVTVSS

SEQ ID NO: 958 - DNA, 24 bp, synthetic construct
  misc_feature 1..24: note = Synthetic
  source 1..24: mol_type = other DNA
ggattcaccttcagtatttatgaa

SEQ ID NO: 959 - protein, 8 aa, synthetic construct
  REGION 1..8: note = Synthetic
GFTFSIYE

SEQ ID NO: 960 - DNA, 24 bp, synthetic construct
  misc_feature 1..24: note = Synthetic
  source 1..24: mol_type = other DNA
attactagtagtggttttaccata

SEQ ID NO: 961 - protein, 8 aa, synthetic construct
  REGION 1..8: note = Synthetic
ITSSGFTI

SEQ ID NO: 962 - DNA, 36 bp, synthetic construct
  misc_feature 1..36: note = Synthetic
  source 1..36: mol_type = other DNA
gcgactagcagctcgtccggatactactttgattac

SEQ ID NO: 963 - protein, 12 aa, synthetic construct
  REGION 1..12: note = Synthetic
ATSSSSGYYFDY

SEQ ID NO: 964 - DNA, 339 bp, synthetic construct
  misc_feature 1..339: note = Synthetic
  source 1..339: mol_type = other DNA
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaatctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcccacttttggccaggggaccaagctggagatcaaa

SEQ ID NO: 965 - protein, 113 aa, synthetic construct
  REGION 1..113: note = Synthetic
DIVMTQSPDSLAVSLGERATINCKSSQSVLYSSNNKNYLAWYQQKPGQPPNLLIYWASTRESGVPDRFSGSGSGTDFTLTISSLQAEDVAVYYCQQYYSTPPTFGQGTKLEIK

SEQ ID NO: 966 - DNA, 36 bp, synthetic construct
  misc_feature 1..36: note = Synthetic
  source 1..36: mol_type = other DNA
cagagtgttttatacagctccaacaataagaactac

SEQ ID NO: 967 - protein, 12 aa, synthetic construct
  REGION 1..12: note = Synthetic
QSVLYSSNNKNY

SEQ ID NO: 968-969 - skipped (2 entries)

SEQ ID NO: 970 - DNA, 27 bp, synthetic construct
  misc_feature 1..27: note = Synthetic
  source 1..27: mol_type = other DNA
cagcaatattatagtactcctcccact

SEQ ID NO: 971 - protein, 9 aa, synthetic construct
  REGION 1..9: note = Synthetic
QQYYSTPPT

SEQ ID NO: 972 - DNA, 1350 bp, synthetic construct
  misc_feature 1..1350: note = Synthetic
  source 1..1350: mol_type = other DNA
gaggtgcagctggtggagtctgggggaggcttggtacagcctggagggtccctgagactctcctgtgcagcctctggattcaccttcagtatttatgaaatgaactgggtccgccaggctccagggaaggggctggagtgggtttcatacattactagtagtggttttaccatatactacgcagactctgtgaagggccgattcaccatctccagagacaacgccaagaactcactgtatctgcaaatgcacagcctgagagccgaggacacggctgtttattactgtgcgactagcagctcgtccggatactactttgattactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 973 - protein, 449 aa, synthetic construct
  REGION 1..449: note = Synthetic
EVQLVESGGGLVQPGGSLRLSCAASGFTFSIYEMNWVRQAPGKGLEWVSYITSSGFTIYYADSVKGRFTISRDNAKNSLYLQMHSLRAEDTAVYYCATSSSSGYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 974 - DNA, 663 bp, synthetic construct
  misc_feature 1..663: note = Synthetic
  source 1..663: mol_type = other DNA
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaatctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcccacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 975 - protein, 220 aa, synthetic construct
  REGION 1..220: note = Synthetic
DIVMTQSPDSLAVSLGERATINCKSSQSVLYSSNNKNYLAWYQQKPGQPPNLLIYWASTRESGVPDRFSGSGSGTDFTLTISSLQAEDVAVYYCQQYYSTPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 976 - DNA, 321 bp, synthetic construct
  misc_feature 1..321: note = Synthetic
  source 1..321: mol_type = other DNA
gccatccagatgacccagtctccatcctccctgtctgcatctgtaggagacagagtcaccatcacttgccgggcaagtcaggacattagaaatgatttaggctggtatcagcagaaaccagggaaagcccctaagctcctgatctattctgcatccagtttacaaactggggtcccatcaaggttcagcggcagtggatctggcaccgatttcactctcaccatcagcagcctgcaccctgaagattttgcaacttattactgtctacaagattacgactacacgtggacgttcggccaagggaccaaggtggaaatcaaa

SEQ ID NO: 977 - protein, 107 aa, synthetic construct
  REGION 1..107: note = Synthetic
AIQMTQSPSSLSASVGDRVTITCRASQDIRNDLGWYQQKPGKAPKLLIYSASSLQTGVPSRFSGSGSGTDFTLTISSLHPEDFATYYCLQDYDYTWTFGQGTKVEIK

SEQ ID NO: 978 - DNA, 27 bp, synthetic construct
  misc_feature 1..27: note = Synthetic
  source 1..27: mol_type = other DNA
ctacaagattacgactacacgtggacg

SEQ ID NO: 979 - protein, 9 aa, synthetic construct
  REGION 1..9: note = Synthetic
LQDYDYTWT

SEQ ID NO: 980 - DNA, 645 bp, synthetic construct
  misc_feature 1..645: note = Synthetic
  source 1..645: mol_type = other DNA
gccatccagatgacccagtctccatcctccctgtctgcatctgtaggagacagagtcaccatcacttgccgggcaagtcaggacattagaaatgatttaggctggtatcagcagaaaccagggaaagcccctaagctcctgatctattctgcatccagtttacaaactggggtcccatcaaggttcagcggcagtggatctggcaccgatttcactctcaccatcagcagcctgcaccctgaagattttgcaacttattactgtctacaagattacgactacacgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 981 - protein, 214 aa, synthetic construct
  REGION 1..214: note = Synthetic
AIQMTQSPSSLSASVGDRVTITCRASQDIRNDLGWYQQKPGKAPKLLIYSASSLQTGVPSRFSGSGSGTDFTLTISSLHPEDFATYYCLQDYDYTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 982 - DNA, 321 bp, synthetic construct
  misc_feature 1..321: note = Synthetic
  source 1..321: mol_type = other DNA
gccatccagatgacccagtctccatcctccctgtctgcatctgtaggagacagagtcaccatcacttgccgggcaagtcaggacattagaaatgatttaggctggtatcagcagaaaccagggaaagcccctaagctcctgatctattctgcatccagtttacaaactggggtcccatcaaggttcagcggcagtggatctggcaccgatttcactctcaccatcagcagcctgcaccctgaagattttgcaacttattactgtctacaagattactggtacacgtggacgttcggccaagggaccaaggtggaaatcaaa

SEQ ID NO: 983 - protein, 107 aa, synthetic construct
  REGION 1..107: note = Synthetic
AIQMTQSPSSLSASVGDRVTITCRASQDIRNDLGWYQQKPGKAPKLLIYSASSLQTGVPSRFSGSGSGTDFTLTISSLHPEDFATYYCLQDYWYTWTFGQGTKVEIK

SEQ ID NO: 984 - DNA, 27 bp, synthetic construct
  misc_feature 1..27: note = Synthetic
  source 1..27: mol_type = other DNA
ctacaagattactggtacacgtggacg

SEQ ID NO: 985 - protein, 9 aa, synthetic construct
  REGION 1..9: note = Synthetic
LQDYWYTWT

SEQ ID NO: 986 - DNA, 645 bp, synthetic construct
  misc_feature 1..645: note = Synthetic
  source 1..645: mol_type = other DNA
gccatccagatgacccagtctccatcctccctgtctgcatctgtaggagacagagtcaccatcacttgccgggcaagtcaggacattagaaatgatttaggctggtatcagcagaaaccagggaaagcccctaagctcctgatctattctgcatccagtttacaaactggggtcccatcaaggttcagcggcagtggatctggcaccgatttcactctcaccatcagcagcctgcaccctgaagattttgcaacttattactgtctacaagattactggtacacgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 987 - protein, 214 aa, synthetic construct
  REGION 1..214: note = Synthetic
AIQMTQSPSSLSASVGDRVTITCRASQDIRNDLGWYQQKPGKAPKLLIYSASSLQTGVPSRFSGSGSGTDFTLTISSLHPEDFATYYCLQDYWYTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 988 - DNA, 378 bp, synthetic construct
  misc_feature 1..378: note = Synthetic
  source 1..378: mol_type = other DNA
gaggtgcagctggtggagtccgggggaggcttagttcagcctggggggtccctgagactctcctgtgcagcctctggattcaccttcagtaaccactggatggactgggtccgccaagctccagggaaggggctggtgtgggtctcacgtattaatagtgatgggagtagcacagactacgcggactccgtgaggggccgcttcaccatgtccagagacaacgccaagaacacgctgtatttgcaaatgagcagtctgagagccgaggacacggctgtgtattactgtgcaagagaagggatgatttttggagcggttattataccgggatggtacttcgatctctggggccgtggcgccctggtcactgtctcctca

SEQ ID NO: 989 - protein, 126 aa, synthetic construct
  REGION 1..126: note = Synthetic
EVQLVESGGGLVQPGGSLRLSCAASGFTFSNHWMDWVRQAPGKGLVWVSRINSDGSSTDYADSVRGRFTMSRDNAKNTLYLQMSSLRAEDTAVYYCAREGMIFGAVIIPGWYFDLWGRGALVTVSS

SEQ ID NO: 990 - DNA, 24 bp, synthetic construct
  misc_feature 1..24: note = Synthetic
  source 1..24: mol_type = other DNA
ggattcaccttcagtaaccactgg

SEQ ID NO: 991 - protein, 8 aa, synthetic construct
  REGION 1..8: note = Synthetic
GFTFSNHW

SEQ ID NO: 992 - DNA, 24 bp, synthetic construct
  misc_feature 1..24: note = Synthetic
  source 1..24: mol_type = other DNA
attaatagtgatgggagtagcaca

SEQ ID NO: 993 - protein, 8 aa, synthetic construct
  REGION 1..8: note = Synthetic
INSDGSST

SEQ ID NO: 994 - DNA, 57 bp, synthetic construct
  misc_feature 1..57: note = Synthetic
  source 1..57: mol_type = other DNA
gcaagagaagggatgatttttggagcggttattataccgggatggtacttcgatctc

SEQ ID NO: 995 - protein, 19 aa, synthetic construct
  REGION 1..19: note = Synthetic
AREGMIFGAVIIPGWYFDL

SEQ ID NO: 996 - DNA, 312 bp, synthetic construct
  misc_feature 1..312: note = Synthetic
  source 1..312: mol_type = other DNA
gaaattgtgttgacgcagtctccaggcaccctgtctttgtctccgggggaaagagccaccctctcctgcagggccagtcagagtgttagcagcagccagttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatgatagcttcggccaggggaccaagctggagatcaaa

SEQ ID NO: 997 - protein, 104 aa, synthetic construct
  REGION 1..104: note = Synthetic
EIVLTQSPGTLSLSPGERATLSCRASQSVSSSQLAWYQQKPGQAPRLLIYGASSRATGIPDRFSGSGSGTDFTLTISRLEPEDFAVYYCQQYDSFGQGTKLEIK

SEQ ID NO: 998 - DNA, 21 bp, synthetic construct
  misc_feature 1..21: note = Synthetic
  source 1..21: mol_type = other DNA
cagagtgttagcagcagccag

SEQ ID NO: 999 - protein, 7 aa, synthetic construct
  REGION 1..7: note = Synthetic
QSVSSSQ

SEQ ID NO: 1000-1001 - skipped (2 entries)

SEQ ID NO: 1002 - DNA, 15 bp, synthetic construct
  misc_feature 1..15: note = Synthetic
  source 1..15: mol_type = other DNA
cagcagtatgatagc

SEQ ID NO: 1003 - protein, 5 aa, synthetic construct
  REGION 1..5: note = Synthetic
QQYDS

SEQ ID NO: 1004 - DNA, 1371 bp, synthetic construct
  misc_feature 1..1371: note = Synthetic
  source 1..1371: mol_type = other DNA
gaggtgcagctggtggagtccgggggaggcttagttcagcctggggggtccctgagactctcctgtgcagcctctggattcaccttcagtaaccactggatggactgggtccgccaagctccagggaaggggctggtgtgggtctcacgtattaatagtgatgggagtagcacagactacgcggactccgtgaggggccgcttcaccatgtccagagacaacgccaagaacacgctgtatttgcaaatgagcagtctgagagccgaggacacggctgtgtattactgtgcaagagaagggatgatttttggagcggttattataccgggatggtacttcgatctctggggccgtggcgccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 1005 - protein, 456 aa, synthetic construct
  REGION 1..456: note = Synthetic
EVQLVESGGGLVQPGGSLRLSCAASGFTFSNHWMDWVRQAPGKGLVWVSRINSDGSSTDYADSVRGRFTMSRDNAKNTLYLQMSSLRAEDTAVYYCAREGMIFGAVIIPGWYFDLWGRGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1006 - DNA, 636 bp, synthetic construct
  misc_feature 1..636: note = Synthetic
  source 1..636: mol_type = other DNA
gaaattgtgttgacgcagtctccaggcaccctgtctttgtctccgggggaaagagccaccctctcctgcagggccagtcagagtgttagcagcagccagttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatgatagcttcggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 1007 - protein, 211 aa, synthetic construct
  REGION 1..211: note = Synthetic
EIVLTQSPGTLSLSPGERATLSCRASQSVSSSQLAWYQQKPGQAPRLLIYGASSRATGIPDRFSGSGSGTDFTLTISRLEPEDFAVYYCQQYDSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1008 - protein, 1273 aa, synthetic construct
  REGION 1..1273: note = Synthetic
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1009 - DNA, 360 bp, synthetic construct
  misc_feature 1..360: note = Synthetic
  source 1..360: mol_type = other DNA
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattacttatagtggtagtaccatatactacgcagactctgtgaagggccgattcaccatctccagggacaacgccaagagctcactgtatctgcaaatgaacagcctgagagccgaggacacggccgtgtattactgtgcgagagatcgcggtacaactatggtcccctttgactactggggccagggaaccctggtcaccgtctcctca

SEQ ID NO: 1010 - protein, 120 aa, synthetic construct
  REGION 1..120: note = Synthetic
QVQLVESGGGLVKPGGSLRLSCAASGFTFSDYYMSWIRQAPGKGLEWVSYITYSGSTIYYADSVKGRFTISRDNAKSSLYLQMNSLRAEDTAVYYCARDRGTTMVPFDYWGQGTLVTVSS

SEQ ID NO: 1011 - DNA, 24 bp, synthetic construct
  misc_feature 1..24: note = Synthetic
  source 1..24: mol_type = other DNA
ggattcaccttcagtgactactac

SEQ ID NO: 1012 - protein, 8 aa, synthetic construct
  REGION 1..8: note = Synthetic
GFTFSDYY

SEQ ID NO: 1013 - DNA, 24 bp, synthetic construct
  misc_feature 1..24: note = Synthetic
  source 1..24: mol_type = other DNA
attacttatagtggtagtaccata

SEQ ID NO: 1014 - protein, 8 aa, synthetic construct
  REGION 1..8: note = Synthetic
ITYSGSTI

SEQ ID NO: 1015 - DNA, 39 bp, synthetic construct
  misc_feature 1..39: note = Synthetic
  source 1..39: mol_type = other DNA
gcgagagatcgcggtacaactatggtcccctttgactac

SEQ ID NO: 1016 - protein, 13 aa, synthetic construct
  REGION 1..13: note = Synthetic
ARDRGTTMVPFDY

SEQ ID NO: 1017 - DNA, 321 bp, synthetic construct
  misc_feature 1..321: note = Synthetic
  source 1..321: mol_type = other DNA
gacatccagatgacccagtctccatcctccctgtctgcatctgtaggagacagagtcaccatcacttgccaggcgagtcaggacattaccaactatttaaattggtatcagcagaaaccagggaaagcccctaagctcctgatctacgctgcatccaatttggaaacaggggtcccatcaaggttcagtggaagtggatctgggacagattttactttcaccatcagcggcctgcagcctgaagatattgcaacatattactgtcaacagtatgataatctccctctcactttcggcggagggaccaaggtggagatcaaa

SEQ ID NO: 1018 - protein, 107 aa, synthetic construct
  REGION 1..107: note = Synthetic
DIQMTQSPSSLSASVGDRVTITCQASQDITNYLNWYQQKPGKAPKLLIYAASNLETGVPSRFSGSGSGTDFTFTISGLQPEDIATYYCQQYDNLPLTFGGGTKVEIK

SEQ ID NO: 1019 - DNA, 18 bp, synthetic construct
  misc_feature 1..18: note = Synthetic
  source 1..18: mol_type = other DNA
caggacattaccaactat

SEQ ID NO: 1020 - protein, 6 aa, synthetic construct
  REGION 1..6: note = Synthetic
QDITNY

SEQ ID NO: 1021-1022 - skipped (2 entries)

SEQ ID NO: 1023 - DNA, 27 bp, synthetic construct
  misc_feature 1..27: note = Synthetic
  source 1..27: mol_type = other DNA
caacagtatgataatctccctctcact

SEQ ID NO: 1024 - protein, 9 aa, synthetic construct
  REGION 1..9: note = Synthetic
QQYDNLPLT

SEQ ID NO: 1025 - DNA, 1353 bp, synthetic construct
  misc_feature 1..1353: note = Synthetic
  source 1..1353: mol_type = other DNA
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattacttatagtggtagtaccatatactacgcagactctgtgaagggccgattcaccatctccagggacaacgccaagagctcactgtatctgcaaatgaacagcctgagagccgaggacacggccgtgtattactgtgcgagagatcgcggtacaactatggtcccctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 1026 - protein, 450 aa, synthetic construct
  REGION 1..450: note = Synthetic
QVQLVESGGGLVKPGGSLRLSCAASGFTFSDYYMSWIRQAPGKGLEWVSYITYSGSTIYYADSVKGRFTISRDNAKSSLYLQMNSLRAEDTAVYYCARDRGTTMVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1027 - DNA, 645 bp, synthetic construct
  misc_feature 1..645: note = Synthetic
  source 1..645: mol_type = other DNA
gacatccagatgacccagtctccatcctccctgtctgcatctgtaggagacagagtcaccatcacttgccaggcgagtcaggacattaccaactatttaaattggtatcagcagaaaccagggaaagcccctaagctcctgatctacgctgcatccaatttggaaacaggggtcccatcaaggttcagtggaagtggatctgggacagattttactttcaccatcagcggcctgcagcctgaagatattgcaacatattactgtcaacagtatgataatctccctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 1028 - protein, 214 aa, synthetic construct
  REGION 1..214: note = Synthetic
DIQMTQSPSSLSASVGDRVTITCQASQDITNYLNWYQQKPGKAPKLLIYAASNLETGVPSRFSGSGSGTDFTFTISGLQPEDIATYYCQQYDNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1029 - DNA, 360 bp, synthetic construct
  misc_feature 1..360: note = Synthetic
  source 1..360: mol_type = other DNA
caggtgcagctggtggagtctgggggaggcgtggtccagcctgggaggtccctgagactctcctgtgcagcctctggattcaccttcagtaactatgctatgtactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagaactgaggacacggctgtgtattactgtgcgagtggctccgactacggtgactacttattggtttactggggccagggaaccctggtcaccgtctcctca

SEQ ID NO: 1030 - protein, 120 aa, synthetic construct
  REGION 1..120: note = Synthetic
QVQLVESGGGVVQPGRSLRLSCAASGFTFSNYAMYWVRQAPGKGLEWVAVISYDGSNKYYADSVKGRFTISRDNSKNTLYLQMNSLRTEDTAVYYCASGSDYGDYLLVYWGQGTLVTVSS

SEQ ID NO: 1031 - DNA, 24 bp, synthetic construct
  misc_feature 1..24: note = Synthetic
  source 1..24: mol_type = other DNA
ggattcaccttcagtaactatgct

SEQ ID NO: 1032 - protein, 8 aa, synthetic construct
  REGION 1..8: note = Synthetic
GFTFSNYA

SEQ ID NO: 1033 - DNA, 24 bp, synthetic construct
  misc_feature 1..24: note = Synthetic
  source 1..24: mol_type = other DNA
atatcatatgatggaagtaataaa

SEQ ID NO: 1034 - protein, 8 aa, synthetic construct
  REGION 1..8: note = Synthetic
ISYDGSNK

SEQ ID NO: 1035 - DNA, 39 bp, synthetic construct
  misc_feature 1..39: note = Synthetic
  source 1..39: mol_type = other DNA
gcgagtggctccgactacggtgactacttattggtttac

SEQ ID NO: 1036 - protein, 13 aa, synthetic construct
  REGION 1..13: note = Synthetic
ASGSDYGDYLLVY

SEQ ID NO: 1037 - DNA, 330 bp, synthetic construct
  misc_feature 1..330: note = Synthetic
  source 1..330: mol_type = other DNA
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaagcggccctcaggggtttctaatcgcttctctggctccaagtctggcaacacggcctccctgaccatctctgggctccagtctgaggacgaggctgattattactgcaactctttgacaagcatcagcacttgggtgttcggcggagggaccaagctgaccgtccta

SEQ ID NO: 1038 - protein, 110 aa, synthetic construct
  REGION 1..110: note = Synthetic
QSALTQPASVSGSPGQSITISCTGTSSDVGGYNYVSWYQQHPGKAPKLMIYDVSKRPSGVSNRFSGSKSGNTASLTISGLQSEDEADYYCNSLTSISTWVFGGGTKLTVL

SEQ ID NO: 1039 - DNA, 27 bp, synthetic construct
  misc_feature 1..27: note = Synthetic
  source 1..27: mol_type = other DNA
agcagtgacgttggtggttataactat

SEQ ID NO: 1040 - protein, 9 aa, synthetic construct
  REGION 1..9: note = Synthetic
SSDVGGYNY

SEQ ID NO: 1041-1042 - skipped (2 entries)

SEQ ID NO: 1043 - DNA, 30 bp, synthetic construct
  misc_feature 1..30: note = Synthetic
  source 1..30: mol_type = other DNA
aactctttgacaagcatcagcacttgggtg

SEQ ID NO: 1044 - protein, 10 aa, synthetic construct
  REGION 1..10: note = Synthetic
NSLTSISTWV

SEQ ID NO: 1045 - DNA, 1353 bp, synthetic construct
  misc_feature 1..1353: note = Synthetic
  source 1..1353: mol_type = other DNA
caggtgcagctggtggagtctgggggaggcgtggtccagcctgggaggtccctgagactctcctgtgcagcctctggattcaccttcagtaactatgctatgtactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagaactgaggacacggctgtgtattactgtgcgagtggctccgactacggtgactacttattggtttactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 1046 - protein, 450 aa, synthetic construct
  REGION 1..450: note = Synthetic
QVQLVESGGGVVQPGRSLRLSCAASGFTFSNYAMYWVRQAPGKGLEWVAVISYDGSNKYYADSVKGRFTISRDNSKNTLYLQMNSLRTEDTAVYYCASGSDYGDYLLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1047 - DNA, 651 bp, synthetic construct
  misc_feature 1..651: note = Synthetic
  source 1..651: mol_type = other DNA
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaagcggccctcaggggtttctaatcgcttctctggctccaagtctggcaacacggcctccctgaccatctctgggctccagtctgaggacgaggctgattattactgcaactctttgacaagcatcagcacttgggtgttcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 1048 - protein, 216 aa, synthetic construct
  REGION 1..216: note = Synthetic
QSALTQPASVSGSPGQSITISCTGTSSDVGGYNYVSWYQQHPGKAPKLMIYDVSKRPSGVSNRFSGSKSGNTASLTISGLQSEDEADYYCNSLTSISTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1049 - DNA, 384 bp, synthetic construct
  misc_feature 1..384: note = Synthetic
  source 1..384: mol_type = other DNA
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaataggggtagcataggctatgcggactctgtgaagggccgattcaccatctccagagacaacgccaagaactccctgtatctgcaaatgagcagtctgagagctgaggacacggccttgtattactgcgcaaaagatggcgagagatgggatagtgtagtagtaccatctgctaggaacggtatggacgtctggggccaagggaccacggtcaccgtctcctca

SEQ ID NO: 1050 - protein, 128 aa, synthetic construct
  REGION 1..128: note = Synthetic
EVQLVESGGGLVQPGRSLRLSCAASGFTFDDYAMHWVRQAPGKGLEWVSGISWNRGSIGYADSVKGRFTISRDNAKNSLYLQMSSLRAEDTALYYCAKDGERWDSVVVPSARNGMDVWGQGTTVTVSS

SEQ ID NO: 1051 - DNA, 24 bp, synthetic construct
  misc_feature 1..24: note = Synthetic
  source 1..24: mol_type = other DNA
ggattcacctttgatgattatgcc

SEQ ID NO: 1052 - protein, 8 aa, synthetic construct
  REGION 1..8: note = Synthetic
GFTFDDYA

SEQ ID NO: 1053 - DNA, 24 bp, synthetic construct
  misc_feature 1..24: note = Synthetic
  source 1..24: mol_type = other DNA
attagttggaataggggtagcata

SEQ ID NO: 1054 - protein, 8 aa, synthetic construct
  REGION 1..8: note = Synthetic
ISWNRGSI

SEQ ID NO: 1055 - DNA, 63 bp, synthetic construct
  misc_feature 1..63: note = Synthetic
  source 1..63: mol_type = other DNA
gcaaaagatggcgagagatgggatagtgtagtagtaccatctgctaggaacggtatggacgtc

SEQ ID NO: 1056 - protein, 21 aa, synthetic construct
  REGION 1..21: note = Synthetic
AKDGERWDSVVVPSARNGMDV

SEQ ID NO: 1057 - DNA, 336 bp, synthetic construct
  misc_feature 1..336: note = Synthetic
  source 1..336: mol_type = other DNA
cagtctgtgctgacgcagccgccctcagtgtctggggccccagggcagagggtcaccatctcctgcactgggagcagctccaacatcggggcaggttatgatgtacattggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggctcttatgtcttcggaactgggaccaaggtcaccgtccta

SEQ ID NO: 1058 - protein, 112 aa, synthetic construct
  REGION 1..112: note = Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKVTVL

SEQ ID NO: 1059 - DNA, 27 bp, synthetic construct
  misc_feature 1..27: note = Synthetic
  source 1..27: mol_type = other DNA
agctccaacatcggggcaggttatgat

SEQ ID NO: 1060 - protein, 9 aa, synthetic construct
  REGION 1..9: note = Synthetic
SSNIGAGYD

SEQ ID NO: 1061-1062 - skipped (2 entries)

SEQ ID NO: 1063 - DNA, 36 bp, synthetic construct
  misc_feature 1..36: note = Synthetic
  source 1..36: mol_type = other DNA
cagtcctatgacagcagcctgagtggctcttatgtc

SEQ ID NO: 1064 - protein, 12 aa, synthetic construct
  REGION 1..12: note = Synthetic
QSYDSSLSGSYV

SEQ ID NO: 1065 - DNA, 1377 bp, synthetic construct
  misc_feature 1..1377: note = Synthetic
  source 1..1377: mol_type = other DNA
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaataggggtagcataggctatgcggactctgtgaagggccgattcaccatctccagagacaacgccaagaactccctgtatctgcaaatgagcagtctgagagctgaggacacggccttgtattactgcgcaaaagatggcgagagatgggatagtgtagtagtaccatctgctaggaacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 1066 - protein, 458 aa, synthetic construct
  REGION 1..458: note = Synthetic
EVQLVESGGGLVQPGRSLRLSCAASGFTFDDYAMHWVRQAPGKGLEWVSGISWNRGSIGYADSVKGRFTISRDNAKNSLYLQMSSLRAEDTALYYCAKDGERWDSVVVPSARNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1067 - DNA, 657 bp, synthetic construct
  misc_feature 1..657: note = Synthetic
  source 1..657: mol_type = other DNA
cagtctgtgctgacgcagccgccctcagtgtctggggccccagggcagagggtcaccatctcctgcactgggagcagctccaacatcggggcaggttatgatgtacattggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggctcttatgtcttcggaactgggaccaaggtcaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 1068 - protein, 218 aa, synthetic construct
  REGION 1..218: note = Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1069 - protein, 251 aa, synthetic construct
  REGION 1..251: note = Synthetic
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFEQKLISEEDLGGEQKLISEEDLHHHHHH

SEQ ID NO: 1070 - protein, 456 aa, synthetic construct
  REGION 1..456: note = Synthetic
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 1071 - protein, 1242 aa, synthetic construct
  REGION 1..1242: note = Synthetic
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCK

SEQ ID NO: 1072 - protein, 1270 aa, synthetic construct
  REGION 1..1270: note = Synthetic
MFVFLVLLPLVSSQCVNLTTRTQLPPAYTNSFTRGVYYPDKVFRSSVLHSTQDLFLPFFSNVTWFHVISGTNGTKRFDNPVLPFNDGVYFASIEKSNIIRGWIFGTTLDSKTQSLLIVNNATNVVIKVCEFQFCNDPFLDHKNNKSWMESEFRVYSSANNCTFEYVSQPFLMDLEGKQGNFKNLREFVFKNIDGYFKIYSKHTPIIVREPEDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNLAPFFTFKCYGVSPTKLNDLCFTNVYADSFVIRGDEVRQIAPGQTGNIADYNYKLPDDFTGCVIAWNSNKLDSKVSGNYNYLYRLFRKSNLKPFERDISTEIYQAGNKPCNGVAGFNCYFPLRSYSFRPTYGVGHQPYRVVVLSFELLHAPATVCGPKKSTNLVKNKCVNFNFNGLKGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFKGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDIFSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1073 - protein, 1239 aa, synthetic construct
  REGION 1..1239: note = Synthetic
QCVNLTTRTQLPPAYTNSFTRGVYYPDKVFRSSVLHSTQDLFLPFFSNVTWFHVISGTNGTKRFDNPVLPFNDGVYFASIEKSNIIRGWIFGTTLDSKTQSLLIVNNATNVVIKVCEFQFCNDPFLDHKNNKSWMESEFRVYSSANNCTFEYVSQPFLMDLEGKQGNFKNLREFVFKNIDGYFKIYSKHTPIIVREPEDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNLAPFFTFKCYGVSPTKLNDLCFTNVYADSFVIRGDEVRQIAPGQTGNIADYNYKLPDDFTGCVIAWNSNKLDSKVSGNYNYLYRLFRKSNLKPFERDISTEIYQAGNKPCNGVAGFNCYFPLRSYSFRPTYGVGHQPYRVVVLSFELLHAPATVCGPKKSTNLVKNKCVNFNFNGLKGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFKGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDIFSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCK

SEQ ID NO: 1074 - DNA, 1350 bp, synthetic construct
  misc_feature 1..1350: note = Synthetic
  source 1..1350: mol_type = other DNA
cagatcaccttgaaggagtctggtcctacgctggtgaaacccacacagaccctcacgctgacctgcaccttctctgggttctcatttagcacttctggagtgggtgtgggctggatccgtcagcccccaggaaagaccctggagtggcttgcactcatttattgggatgatgataagcgctacagcccatctctgaagagcaggctcaccattaccaaggacacctccaaaaaccaggtggtccttacaatgaccaacatggaccctgtggacactgccacatatttctgtgcacaccatggaatacctacgatctttggctactggggccagggagccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctctatatcacccgggaacctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 1075 - protein, 449 aa, synthetic construct
  REGION 1..449: note = Synthetic
QITLKESGPTLVKPTQTLTLTCTFSGFSFSTSGVGVGWIRQPPGKTLEWLALIYWDDDKRYSPSLKSRLTITKDTSKNQVVLTMTNMDPVDTATYFCAHHGIPTIFGYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1076 - DNA, 1362 bp, synthetic construct
  misc_feature 1..1362: note = Synthetic
  source 1..1362: mol_type = other DNA
gaggtgcagctggtggagtctgggggaggcttggtccagcctggggggtccctgagactctcctgttcagcctctggattcaccttcagtaggtacgctatgtactgggtccgccaggctccagggaagggactggaatatgtttcagctattagtagtgatgggggtagcacatacgacgcagactccgtgaagggcagattcaccatctccagagccaattccaagaacacgctgtaccttcaaatgagcagtctgagagctgaggacacggctgtgtattattgtgtgaaaggtctgcgggagttactctactactattacggaatggacgtctggggccaagggactacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctctatatcacccgggaacctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 1077 - protein, 453 aa, synthetic construct
  REGION 1..453: note = Synthetic
EVQLVESGGGLVQPGGSLRLSCSASGFTFSRYAMYWVRQAPGKGLEYVSAISSDGGSTYDADSVKGRFTISRANSKNTLYLQMSSLRAEDTAVYYCVKGLRELLYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

We claim:

1. An isolated recombinant antibody or antigen-binding fragment thereof that specifically binds to a coronavirus spike protein (CoV-S), wherein the antibody or antigen-binding fragment comprises:
   a heavy chain variable region (HCVR) comprising three heavy chain complementarity determining regions (CDRs) (HCDR1, HCDR2, and HCDR3); and a light chain variable region (LCVR) comprising three light chain CDRs (LCDR1, LCDR2, and LCDR3);
   wherein the HCDR1, HCDR2, HCDR3, LCDR1, LCDR2, and LCDR3, comprise, respectively, the amino acid sequences of:
   SEQ ID NO: 4, SEQ ID NO: 6, SEQ ID NO: 8, SEQ ID NO: 12, EVS, and SEQ ID NO: 16;
   SEQ ID NO: 24, SEQ ID NO: 26, SEQ ID NO: 28, SEQ ID NO: 32, EGN, and SEQ ID NO: 36;
   SEQ ID NO: 44, SEQ ID NO: 26, SEQ ID NO: 47, SEQ ID NO: 51, EGN, and SEQ ID NO: 36;
   SEQ ID NO: 60, SEQ ID NO: 62, SEQ ID NO: 64, SEQ ID NO: 51, EGT, and SEQ ID NO: 36;
   SEQ ID NO: 76, SEQ ID NO: 78, SEQ ID NO: 80, SEQ ID NO: 84, EDS, and SEQ ID NO: 88;
   SEQ ID NO: 96, SEQ ID NO: 98, SEQ ID NO: 100, SEQ ID NO: 104, AAS, and SEQ ID NO: 108;
   SEQ ID NO: 116, SEQ ID NO: 118, SEQ ID NO: 120, SEQ ID NO: 124, GAS, and SEQ ID NO: 128;
   SEQ ID NO: 136, SEQ ID NO: 138, SEQ ID NO: 140, SEQ ID NO: 144, GAS, and SEQ ID NO: 146;
   SEQ ID NO: 154, SEQ ID NO: 156, SEQ ID NO: 158, SEQ ID NO: 162, GNS, and SEQ ID NO: 166;
   SEQ ID NO: 174, SEQ ID NO: 176, SEQ ID NO: 178, SEQ ID NO: 182, SND, and SEQ ID NO: 186;
   SEQ ID NO: 194, SEQ ID NO: 196, SEQ ID NO: 198, SEQ ID NO: 202, DND, and SEQ ID NO: 206;
   SEQ ID NO: 214, SEQ ID NO: 216, SEQ ID NO: 218, SEQ ID NO: 222, GAS, and SEQ ID NO: 224;
   SEQ ID NO: 232, SEQ ID NO: 234, SEQ ID NO: 236, SEQ ID NO: 240, DAS, and SEQ ID NO: 244;
   SEQ ID NO: 252, SEQ ID NO: 254, SEQ ID NO: 256, SEQ ID NO: 260, GAT, and SEQ ID NO: 264;
   SEQ ID NO: 272, SEQ ID NO: 274, SEQ ID NO: 276, SEQ ID NO: 280, AAS, and SEQ ID NO: 282;
   SEQ ID NO: 290, SEQ ID NO: 292, SEQ ID NO: 294, SEQ ID NO: 298, SDN, and SEQ ID NO: 302;
   SEQ ID NO: 310, SEQ ID NO: 312, SEQ ID NO: 314, SEQ ID NO: 318, VNN, and SEQ ID NO: 322;
   SEQ ID NO: 330, SEQ ID NO: 332, SEQ ID NO: 334, SEQ ID NO: 338, AAS, and SEQ ID NO: 340;
   SEQ ID NO: 96, SEQ ID NO: 98, SEQ ID NO: 350, SEQ ID NO: 354, AAS, and SEQ ID NO: 356;
   SEQ ID NO: 364, SEQ ID NO: 366, SEQ ID NO: 368, SEQ ID NO: 372, AAS, and SEQ ID NO: 374;
   SEQ ID NO: 382, SEQ ID NO: 384, SEQ ID NO: 386, SEQ ID NO: 390, KAS, and SEQ ID NO: 394;

SEQ ID NO: 402, SEQ ID NO: 98, SEQ ID NO: 405, SEQ ID NO: 409, DAS, and SEQ ID NO: 411;
SEQ ID NO: 419, SEQ ID NO: 421, SEQ ID NO: 423, SEQ ID NO: 427, EVS, and SEQ ID NO: 429;
SEQ ID NO: 437, SEQ ID NO: 138, SEQ ID NO: 440, SEQ ID NO: 444, DKN, and SEQ ID NO: 448;
SEQ ID NO: 456, SEQ ID NO: 458, SEQ ID NO: 460, SEQ ID NO: 84, ELT, and SEQ ID NO: 467;
SEQ ID NO: 475, SEQ ID NO: 477, SEQ ID NO: 479, SEQ ID NO: 483, DVT, and SEQ ID NO: 487;
SEQ ID NO: 495, SEQ ID NO: 497, SEQ ID NO: 499, SEQ ID NO: 503, EVT, and SEQ ID NO: 507;
SEQ ID NO: 515, SEQ ID NO: 517, SEQ ID NO: 519, SEQ ID NO: 523, EGS, and SEQ ID NO: 36;
SEQ ID NO: 533, SEQ ID NO: 535, SEQ ID NO: 537, SEQ ID NO: 483, DVS, and SEQ ID NO: 544;
SEQ ID NO: 552, SEQ ID NO: 554, SEQ ID NO: 556, SEQ ID NO: 84, EVS, and SEQ ID NO: 560;
SEQ ID NO: 568, SEQ ID NO: 570, SEQ ID NO: 572, SEQ ID NO: 576, ENN, and SEQ ID NO: 580;
SEQ ID NO: 588, SEQ ID NO: 590, SEQ ID NO: 592, SEQ ID NO: 596, GAS, and SEQ ID NO: 598;
SEQ ID NO: 606, SEQ ID NO: 608, SEQ ID NO: 610, SEQ ID NO: 614, GAS, and SEQ ID NO: 616;
SEQ ID NO: 624, SEQ ID NO: 626, SEQ ID NO: 628, SEQ ID NO: 632, LGS, and SEQ ID NO: 636;
SEQ ID NO: 644, SEQ ID NO: 646, SEQ ID NO: 648, SEQ ID NO: 652, LGS, and SEQ ID NO: 655;
SEQ ID NO: 663, SEQ ID NO: 665, SEQ ID NO: 667, SEQ ID NO: 124, GAS, and SEQ ID NO: 671;
SEQ ID NO: 679, SEQ ID NO: 78, SEQ ID NO: 682, SEQ ID NO: 686, GAS, and SEQ ID NO: 688;
SEQ ID NO: 696, SEQ ID NO: 698, SEQ ID NO: 700, SEQ ID NO: 704, SAS, and SEQ ID NO: 708;
SEQ ID NO: 696, SEQ ID NO: 716, SEQ ID NO: 718, SEQ ID NO: 722, GAS, and SEQ ID NO: 724;
SEQ ID NO: 732, SEQ ID NO: 734, SEQ ID NO: 736, SEQ ID NO: 740, AAS, and SEQ ID NO: 742;
SEQ ID NO: 750, SEQ ID NO: 497, SEQ ID NO: 752, SEQ ID NO: 756, EVT, and SEQ ID NO: 758;
SEQ ID NO: 766, SEQ ID NO: 768, SEQ ID NO: 770, SEQ ID NO: 774, KDS, and SEQ ID NO: 778;
SEQ ID NO: 786, SEQ ID NO: 788, SEQ ID NO: 790, SEQ ID NO: 794, GNT, and SEQ ID NO: 798;
SEQ ID NO: 806, SEQ ID NO: 497, SEQ ID NO: 808, SEQ ID NO: 812, EVT, and SEQ ID NO: 814;
SEQ ID NO: 822, SEQ ID NO: 497, SEQ ID NO: 825, SEQ ID NO: 756, EVS, and SEQ ID NO: 829;
SEQ ID NO: 837, SEQ ID NO: 839, SEQ ID NO: 841, SEQ ID NO: 845, KIS, and SEQ ID NO: 849;
SEQ ID NO: 857, SEQ ID NO: 859, SEQ ID NO: 861, SEQ ID NO: 865, AAS, and SEQ ID NO: 867;
SEQ ID NO: 76, SEQ ID NO: 876, SEQ ID NO: 878, SEQ ID NO: 84, EDS, and SEQ ID NO: 36;
SEQ ID NO: 889, SEQ ID NO: 891, SEQ ID NO: 893, SEQ ID NO: 897, GNS, and SEQ ID NO: 899;
SEQ ID NO: 154, SEQ ID NO: 908, SEQ ID NO: 910, SEQ ID NO: 914, GHT, and SEQ ID NO: 166;
SEQ ID NO: 924, SEQ ID NO: 926, SEQ ID NO: 928, SEQ ID NO: 576, RNN, and SEQ ID NO: 935;
SEQ ID NO: 943, SEQ ID NO: 945, SEQ ID NO: 947, SEQ ID NO: 951, LGS, and SEQ ID NO: 655;
SEQ ID NO: 959, SEQ ID NO: 961, SEQ ID NO: 963, SEQ ID NO: 967, WAS, and SEQ ID NO: 971;
SEQ ID NO: 696, SEQ ID NO: 698, SEQ ID NO: 700, SEQ ID NO: 704, SAS, and SEQ ID NO: 979;
SEQ ID NO: 696, SEQ ID NO: 698, SEQ ID NO: 700, SEQ ID NO: 704, SAS, and SEQ ID NO: 985; or
SEQ ID NO: 991, SEQ ID NO: 993, SEQ ID NO: 995, SEQ ID NO: 999, GAS, and SEQ ID NO: 1003.

2. The antibody or antigen-binding fragment of claim 1, wherein the antibody or antigen-binding fragment has one or more of the following characteristics:
   (a) binds to CoV-S with an $EC_{50}$ of less than about $10^{-8}$ M; and/or
   (b) demonstrates an increase in survival in a coronavirus-infected animal after administration to said coronavirus-infected animal, as compared to a comparable coronavirus-infected animal without said administration.

3. The antibody or antigen-binding fragment of claim 1, wherein the HCVR and the LCVR comprise, respectively, the amino acid sequences selected from the group consisting of SEQ ID NOs: 2 and 10; 22 and 30; 42 and 49; 58 and 66; 74 and 82; 94 and 102; 114 and 122; 134 and 142; 152 and 160; 172 and 180; 192 and 200; 212 and 220; 230 and 238; 250 and 258; 270 and 278; 288 and 296; 308 and 316; 328 and 336; 346 and 352; 362 and 370; 380 and 388; 400 and 407; 417 and 425; 435 and 442; 454 and 462; 473 and 481; 493 and 501; 513 and 521; 531 and 539; 550 and 558; 566 and 574; 586 and 594; 604 and 612; 622 and 630; 642 and 650; 661 and 669; 677 and 684; 694 and 702; 714 and 720; 730 and 738; 748 and 754; 764 and 772; 784 and 792; 804 and 810; 820 and 827; 835 and 843; 855 and 863; 873 and 880; 887 and 895; 905 and 912; 922 and 930; 941 and 949; 957 and 965; 694 and 977; 694 and 983; and 989 and 997.

4. The antibody or antigen-binding fragment of claim 1, which is an antibody comprising a heavy chain and a light chain, wherein the heavy chain (HC) and the light chain (LC) comprise, respectively, the amino acid sequences selected from the group consisting of SEQ ID NOs: 18 and 20; 38 and 40; 54 and 56; 70 and 72; 90 and 92; 110 and 112; 130 and 132; 148 and 150; 168 and 170; 188 and 190; 208 and 210; 226 and 228; 246 and 248; 266 and 268; 284 and 286; 304 and 306; 324 and 326; 342 and 344; 358 and 360; 376 and 378; 396 and 398; 413 and 415; 431 and 433; 450 and 452; 469 and 471; 489 and 491; 509 and 511; 527 and 529; 546 and 548; 562 and 564; 582 and 584; 600 and 602; 618 and 620; 638 and 640; 657 and 659; 673 and 675; 690 and 692; 710 and 712; 726 and 728; 744 and 746; 760 and 762; 780 and 782; 800 and 802; 816 and 818; 831 and 833; 851 and 853; 869 and 871; 883 and 885; 901 and 903; 918 and 920; 937 and 939; 953 and 955; 973 and 975; 710 and 981; 710 and 987; 1005 and 1007; 1075 and 511; and 1077 and 378.

5. An antibody or antigen-binding fragment thereof that competes with the antibody or antigen-binding fragment of claim 1 for binding to CoV-S, or that binds to the same epitope as, or to an overlapping epitope on, CoV-S as the antibody or antigen-binding fragment of claim 1.

6. The antibody or antigen-binding fragment of claim 1, which:
   (i) is multispecific;
   (ii) comprises one or more of the following properties:
      (a) inhibits growth of coronavirus;
      (b) binds to the surface of a coronavirus;
      (c) limits spread of coronavirus infection of cells in vitro; and
      (d) protects mice engineered to express the human ACE2 or TMPRSS2 protein from death and/or weight loss caused by coronavirus infection; and/or
   (iii) is an antibody or antigen-binding fragment wherein said CoV-S is SARS-COV-2-S.

7. A polynucleotide encoding:
(a) an antibody or antigen-binding fragment thereof of claim 1;
(b) a HCVR and a LCVR comprising the HCVR and LCVR sequences, respectively, selected from the group consisting of SEQ ID NOs: 2 and 10; 22 and 30; 42 and 49; 58 and 66; 74 and 82; 94 and 102; 114 and 122; 134 and 142; 152 and 160; 172 and 180; 192 and 200; 212 and 220; 230 and 238; 250 and 258; 270 and 278; 288 and 296; 308 and 316; 328 and 336; 346 and 352; 362 and 370; 380 and 388; 400 and 407; 417 and 425; 435 and 442; 454 and 462; 473 and 481; 493 and 501; 513 and 521; 531 and 539; 550 and 558; 566 and 574; 586 and 594; 604 and 612; 622 and 630; 642 and 650; 661 and 669; 677 and 684; 694 and 702; 714 and 720; 730 and 738; 748 and 754; 764 and 772; 784 and 792; 804 and 810; 820 and 827; 835 and 843; 855 and 863; 873 and 880; 887 and 895; 905 and 912; 922 and 930; 941 and 949; 957 and 965; 694 and 977; 694 and 983; and 989 and 997; or
(c) a heavy chain (HC) and a light chain (LC) comprising the HC and LC sequences, respectively, selected from the group consisting of SEQ ID NOs: 18 and 20; 38 and 40; 54 and 56; 70 and 72; 90 and 92; 110 and 112; 130 and 132; 148 and 150; 168 and 170; 188 and 190; 208 and 210; 226 and 228; 246 and 248; 266 and 268; 284 and 286; 304 and 306; 324 and 326; 342 and 344; 358 and 360; 376 and 378; 396 and 398; 413 and 415; 431 and 433; 450 and 452; 469 and 471; 489 and 491; 509 and 511; 527 and 529; 546 and 548; 562 and 564; 582 and 584; 600 and 602; 618 and 620; 638 and 640; 657 and 659; 673 and 675; 690 and 692; 710 and 712; 726 and 728; 744 and 746; 760 and 762; 780 and 782; 800 and 802; 816 and 818; 831 and 833; 851 and 853; 869 and 871; 883 and 885; 901 and 903; 918 and 920; 937 and 939; 953 and 955; 973 and 975; 710 and 981; 710 and 987; 1005 and 1007; 1075 and 511; and 1077 and 378.

8. A vector comprising the polynucleotide of claim 7.

9. An isolated host cell comprising the antibody or antigen-binding fragment of claim 1.

10. A pair of polynucleotides, wherein:
(a) the first polynucleotide encodes a heavy chain variable region (HCVR) comprising three heavy chain complementarity determining regions (CDRs) (HCDR1, HCDR2, and HCDR3), and the second polynucleotide encodes a light chain variable region (LCVR) comprising three light chain CDRs (LCDR1, LCDR2, and LCDR3), wherein the HCDR1, HCDR2, HCDR3, LCDR1, LCDR2, and LCDR3, comprise, respectively, the amino acid sequences of:

SEQ ID NO: 4, SEQ ID NO: 6, SEQ ID NO: 8, SEQ ID NO: 12, EVS, and SEQ ID NO: 16;
SEQ ID NO: 24, SEQ ID NO: 26, SEQ ID NO: 28, SEQ ID NO: 32, EGN, and SEQ ID NO: 36;
SEQ ID NO: 44, SEQ ID NO: 26, SEQ ID NO: 47, SEQ ID NO: 51, EGN, and SEQ ID NO: 36;
SEQ ID NO: 60, SEQ ID NO: 62, SEQ ID NO: 64, SEQ ID NO: 51, EGT, and SEQ ID NO: 36;
SEQ ID NO: 76, SEQ ID NO: 78, SEQ ID NO: 80, SEQ ID NO: 84, EDS, and SEQ ID NO: 88;
SEQ ID NO: 96, SEQ ID NO: 98, SEQ ID NO: 100, SEQ ID NO: 104, AAS, and SEQ ID NO: 108;
SEQ ID NO: 116, SEQ ID NO: 118, SEQ ID NO: 120, SEQ ID NO: 124, GAS, and SEQ ID NO: 128;
SEQ ID NO: 136, SEQ ID NO: 138, SEQ ID NO: 140, SEQ ID NO: 144, GAS, and SEQ ID NO: 146;
SEQ ID NO: 154, SEQ ID NO: 156, SEQ ID NO: 158, SEQ ID NO: 162, GNS, and SEQ ID NO: 166;
SEQ ID NO: 174, SEQ ID NO: 176, SEQ ID NO: 178, SEQ ID NO: 182, SND, and SEQ ID NO: 186;
SEQ ID NO: 194, SEQ ID NO: 196, SEQ ID NO: 198, SEQ ID NO: 202, DND, and SEQ ID NO: 206;
SEQ ID NO: 214, SEQ ID NO: 216, SEQ ID NO: 218, SEQ ID NO: 222, GAS, and SEQ ID NO: 224;
SEQ ID NO: 232, SEQ ID NO: 234, SEQ ID NO: 236, SEQ ID NO: 240, DAS, and SEQ ID NO: 244;
SEQ ID NO: 252, SEQ ID NO: 254, SEQ ID NO: 256, SEQ ID NO: 260, GAT, and SEQ ID NO: 264;
SEQ ID NO: 272, SEQ ID NO: 274, SEQ ID NO: 276, SEQ ID NO: 280, AAS, and SEQ ID NO: 282;
SEQ ID NO: 290, SEQ ID NO: 292, SEQ ID NO: 294, SEQ ID NO: 298, SDN, and SEQ ID NO: 302;
SEQ ID NO: 310, SEQ ID NO: 312, SEQ ID NO: 314, SEQ ID NO: 318, VNN, and SEQ ID NO: 322;
SEQ ID NO: 330, SEQ ID NO: 332, SEQ ID NO: 334, SEQ ID NO: 338, AAS, and SEQ ID NO: 340;
SEQ ID NO: 96, SEQ ID NO: 98, SEQ ID NO: 350, SEQ ID NO: 354, AAS, and SEQ ID NO: 356;
SEQ ID NO: 364, SEQ ID NO: 366, SEQ ID NO: 368, SEQ ID NO: 372, AAS, and SEQ ID NO: 374;
SEQ ID NO: 382, SEQ ID NO: 384, SEQ ID NO: 386, SEQ ID NO: 390, KAS, and SEQ ID NO: 394;
SEQ ID NO: 402, SEQ ID NO: 98, SEQ ID NO: 405, SEQ ID NO: 409, DAS, and SEQ ID NO: 411;
SEQ ID NO: 419, SEQ ID NO: 421, SEQ ID NO: 423, SEQ ID NO: 427, EVS, and SEQ ID NO: 429;
SEQ ID NO: 437, SEQ ID NO: 138, SEQ ID NO: 440, SEQ ID NO: 444, DKN, and SEQ ID NO: 448;
SEQ ID NO: 456, SEQ ID NO: 458, SEQ ID NO: 460, SEQ ID NO: 84, ELT, and SEQ ID NO: 467;
SEQ ID NO: 475, SEQ ID NO: 477, SEQ ID NO: 479, SEQ ID NO: 483, DVT, and SEQ ID NO: 487;
SEQ ID NO: 495, SEQ ID NO: 497, SEQ ID NO: 499, SEQ ID NO: 503, EVT, and SEQ ID NO: 507;
SEQ ID NO: 515, SEQ ID NO: 517, SEQ ID NO: 519, SEQ ID NO: 523, EGS, and SEQ ID NO: 36;
SEQ ID NO: 533, SEQ ID NO: 535, SEQ ID NO: 537, SEQ ID NO: 483, DVS, and SEQ ID NO: 544;
SEQ ID NO: 552, SEQ ID NO: 500, SEQ ID NO: 554, SEQ ID NO: 84, EVS, and SEQ ID NO: 560;
SEQ ID NO: 568, SEQ ID NO: 570, SEQ ID NO: 572, SEQ ID NO: 576, ENN, and SEQ ID NO: 580;
SEQ ID NO: 588, SEQ ID NO: 590, SEQ ID NO: 592, SEQ ID NO: 596, GAS, and SEQ ID NO: 598;
SEQ ID NO: 606, SEQ ID NO: 608, SEQ ID NO: 610, SEQ ID NO: 614, GAS, and SEQ ID NO: 616;
SEQ ID NO: 624, SEQ ID NO: 626, SEQ ID NO: 628, SEQ ID NO: 632, LGS, and SEQ ID NO: 636;
SEQ ID NO: 644, SEQ ID NO: 646, SEQ ID NO: 648, SEQ ID NO: 652, LGS, and SEQ ID NO: 655;
SEQ ID NO: 663, SEQ ID NO: 665, SEQ ID NO: 667, SEQ ID NO: 124, GAS, and SEQ ID NO: 671;
SEQ ID NO: 679, SEQ ID NO: 78, SEQ ID NO: 682, SEQ ID NO: 686, GAS, and SEQ ID NO: 688;
SEQ ID NO: 696, SEQ ID NO: 698, SEQ ID NO: 700, SEQ ID NO: 704, SAS, and SEQ ID NO: 708;
SEQ ID NO: 696, SEQ ID NO: 716, SEQ ID NO: 718, SEQ ID NO: 722, GAS, and SEQ ID NO: 724;
SEQ ID NO: 732, SEQ ID NO: 734, SEQ ID NO: 736, SEQ ID NO: 740, AAS, and SEQ ID NO: 742;
SEQ ID NO: 750, SEQ ID NO: 497, SEQ ID NO: 752, SEQ ID NO: 756, EVT, and SEQ ID NO: 758;

SEQ ID NO: 766, SEQ ID NO: 768, SEQ ID NO: 770, SEQ ID NO: 774, KDS, and SEQ ID NO: 778;
SEQ ID NO: 786, SEQ ID NO: 788, SEQ ID NO: 790, SEQ ID NO: 794, GNT, and SEQ ID NO: 798;
SEQ ID NO: 806, SEQ ID NO: 497, SEQ ID NO: 808, SEQ ID NO: 812, EVT, and SEQ ID NO: 814;
SEQ ID NO: 822, SEQ ID NO: 497, SEQ ID NO: 825, SEQ ID NO: 756, EVS, and SEQ ID NO: 829;
SEQ ID NO: 837, SEQ ID NO: 839, SEQ ID NO: 841, SEQ ID NO: 845, KIS, and SEQ ID NO: 849;
SEQ ID NO: 857, SEQ ID NO: 859, SEQ ID NO: 861, SEQ ID NO: 865, AAS, and SEQ ID NO: 867;
SEQ ID NO: 76, SEQ ID NO: 876, SEQ ID NO: 878, SEQ ID NO: 84, EDS, and SEQ ID NO: 36;
SEQ ID NO: 889, SEQ ID NO: 891, SEQ ID NO: 893, SEQ ID NO: 897, GNS, and SEQ ID NO: 899;
SEQ ID NO: 154, SEQ ID NO: 908, SEQ ID NO: 910, SEQ ID NO: 914, GHT, and SEQ ID NO: 166;
SEQ ID NO: 924, SEQ ID NO: 926, SEQ ID NO: 928, SEQ ID NO: 576, RNN, and SEQ ID NO: 935;
SEQ ID NO: 943, SEQ ID NO: 945, SEQ ID NO: 947, SEQ ID NO: 951, LGS, and SEQ ID NO: 655;
SEQ ID NO: 959, SEQ ID NO: 961, SEQ ID NO: 963, SEQ ID NO: 967, WAS, and SEQ ID NO: 971;
SEQ ID NO: 696, SEQ ID NO: 698, SEQ ID NO: 700, SEQ ID NO: 704, SAS, and SEQ ID NO: 979;
SEQ ID NO: 696, SEQ ID NO: 698, SEQ ID NO: 700, SEQ ID NO: 704, SAS, and SEQ ID NO: 985; or
SEQ ID NO: 991, SEQ ID NO: 993, SEQ ID NO: 995, SEQ ID NO: 999, GAS, and SEQ ID NO: 1003;

(b) the first polynucleotide encodes a HCVR, and the second polynucleotide encodes a LCVR, wherein the HCVR and the LCVR comprise, respectively, the amino acid sequences of SEQ ID NOs: 2 and 10; 22 and 30; 42 and 49; 58 and 66; 74 and 82; 94 and 102; 114 and 122; 134 and 142; 152 and 160; 172 and 180; 192 and 200; 212 and 220; 230 and 238; 250 and 258; 270 and 278; 288 and 296; 308 and 316; 328 and 336; 346 and 352; 362 and 370; 380 and 388; 400 and 407; 417 and 425; 435 and 442; 454 and 462; 473 and 481; 493 and 501; 513 and 521; 531 and 539; 550 and 558; 566 and 574; 586 and 594; 604 and 612; 622 and 630; 642 and 650; 661 and 669; 677 and 684; 694 and 702; 714 and 720; 730 and 738; 748 and 754; 764 and 772; 784 and 792; 804 and 810; 820 and 827; 835 and 843; 855 and 863; 873 and 880; 887 and 895; 905 and 912; 922 and 930; 941 and 949; 957 and 965; 694 and 977; 694 and 983; or 989 and 997; or (c) the first polynucleotide a heavy chain, and the second polynucleotide encodes a light chain, wherein the heavy chain and the light chain comprise, respectively, the amino acid sequences of SEQ ID NOs: 18 and 20; 38 and 40; 54 and 56; 70 and 72; 90 and 92; 110 and 112; 130 and 132; 148 and 150; 168 and 170; 188 and 190; 208 and 210; 226 and 228; 246 and 248; 266 and 268; 284 and 286; 304 and 306; 324 and 326; 342 and 344; 358 and 360; 376 and 378; 396 and 398; 413 and 415; 431 and 433; 450 and 452; 469 and 471; 489 and 491; 509 and 511; 527 and 529; 546 and 548; 562 and 564; 582 and 584; 600 and 602; 618 and 620; 638 and 640; 657 and 659; 673 and 675; 690 and 692; 710 and 712; 726 and 728; 744 and 746; 760 and 762; 780 and 782; 800 and 802; 816 and 818; 831 and 833; 851 and 853; 869 and 871; 883 and 885; 901 and 903; 918 and 920; 937 and 939; 953 and 955; 973 and 975; 710 and 981; 710 and 987; 1005 and 1007; 1075 and 511; or 1077 and 378.

11. A composition or kit comprising the antibody or antigen-binding fragment of claim 1 and a further therapeutic agent, or a pharmaceutical composition comprising the antibody or antigen-binding fragment of claim 1 and pharmaceutically acceptable carrier and, optionally, a further therapeutic agent.

12. A vessel or injection device comprising the antibody or antigen-binding fragment of claim 1.

13. The antibody or antigen-binding fragment thereof of claim 1 that (a) neutralizes an omicron variant of SARS-COV-2, or (b) neutralizes an omicron variant selected from BA.1, BA.1.1, BA.2, BA.2.12.1, BA.3, or BA.4/BA.5.

14. The antibody or antigen-binding fragment of claim 1 comprising a heavy chain constant region with 252Y, 254T and 256E modifications.

15. A pair of vectors comprising, respectively, the first polynucleotide and the second polynucleotide of claim 10.

16. An isolated host cell comprising the pair of polynucleotides of claim 10.

17. An isolated host cell comprising the pair of vectors of claim 15.

18. An isolated host cell comprising the polynucleotide of claim 7.

19. An isolated host cell comprising the vector of claim 8.

20. An isolated host cell comprising the antibody or antigen-binding fragment of claim 3.

* * * * *